US011236133B2

(12) United States Patent
Fernandez Rodriguez

(10) Patent No.: US 11,236,133 B2
(45) Date of Patent: Feb. 1, 2022

(54) CHIMERIC RECEPTOR BINDING PROTEINS FOR USE IN BACTERIAL DELIVERY VEHICLES

(71) Applicant: Eligo Bioscience, Paris (FR)

(72) Inventor: Jesus Fernandez Rodriguez, Paris (FR)

(73) Assignee: Eligo Bioscience, Paris (FR)

( * ) Notice: Subject to any disclaimer, the term of this patent is extended or adjusted under 35 U.S.C. 154(b) by 0 days.

(21) Appl. No.: 16/816,675

(22) Filed: Mar. 12, 2020

(65) Prior Publication Data

US 2020/0277337 A1 Sep. 3, 2020

Related U.S. Application Data

(63) Continuation of application No. 16/696,769, filed on Nov. 26, 2019.

(60) Provisional application No. 62/771,761, filed on Nov. 27, 2018, provisional application No. 62/802,777, filed on Feb. 8, 2019.

(51) Int. Cl.
| | |
|---|---|
| *C07K 14/005* | (2006.01) |
| *A61K 38/46* | (2006.01) |
| *C12N 15/71* | (2006.01) |
| *C12N 9/22* | (2006.01) |
| *A61K 48/00* | (2006.01) |

(52) U.S. Cl.
CPC .......... *C07K 14/005* (2013.01); *A61K 38/465* (2013.01); *C12N 9/22* (2013.01); *C12N 15/71* (2013.01); *A61K 48/00* (2013.01); *C07K 2319/00* (2013.01)

(58) Field of Classification Search
None
See application file for complete search history.

(56) References Cited

PUBLICATIONS

Author(s) known, https://en.wikipedia.org/wiki/Bacteriophage, Wikimedia Foundation, Inc., San Francisco, CA, downloaded Nov. 5, 2020, 16 pages as printed.*
Mobley, et al. (2009) Binding of Small-Molecule Ligands to Proteins: 'What You See' Is Not Always 'What You Get', Structure, 17:489-98.*
https://en.wikipedia.org/wiki/Lambdavirus, author unknown, published by Wikipedia, Sanfrancisco, CA, downloaded as PDF on Mar. 1, 21, 3 pages as printed. (Year: 2021).*
Salmond et al. "A century of the phage: past, present and future," Nat. Rev. Microbiol., (Dec. 2015), vol. 13, No. 12; pp. 777-786.
Hyman et al., "Bacteriophage host range and bacterial resistance," Adv. Appl. Microbiol., (2010), vol. 70; pp. 217-248.
Chatterjee et al., "Interaction of Bacteriophage I with Its *E. coli* Receptor, LamB," Viruses, (Nov. 2012), vol. 4, No. 11; pp. 3162-3178.
Nobrega et al., "Targeting mechanisms of tailed bacteriophages," Natural Reviews, Microbiology, (Dec. 2018), vol. 16; pp. 760-773.
Flayhan, et al., "New insights into pb5, the receptor binding protein of bacteriophage T5, and its interaction with its *Escherichia coli* receptor Fhu A," Biochimie, (2012), vol. 94, No. 9; pp. 1982-1989.
Rossmann, et al., "The bacteriophage T4 DNA injection machine," Curr. Opin. Struct. Biol, (Apr. 2004), vol. 14, No. 2; pp. 171-180.
Zivanovic et al., "Insights into Bacteriophage T5 Structure from Analysis of Its Morphogenesis Genes and Protein Components," J. Virol., (Jan. 2014), vol. 88, No. 2; pp. 1162-1174.
Hendrix et al., "Bacteriophage lambda PaPa: not the mother of all lambda phages," Science, (Nov. 1992), vol. 258, No. 5085; pp. 1145-1148.
Speed et al., "Conformation of P22 tailspike folding and aggregation intermediates probed by monoclonal antibodies," Protein Sci. Publ. Protein Soc., (Jan. 1997), vol. 6, No. 1; pp. 99-108.
Labrie et al., "Bacteriophage resistance mechanisms," Nat. Rev. Microbiol., (Mar. 2010), vol. 8, No. 5; pp. 317-327.
Whitfield, "Biosynthesis and assembly of capsular polysaccharides in *Escherichia coli*," Annu. Rev. Biochem., (2006), vol. 75; pp. 39-68.
Meyer et al., "Repeatability and contingency in the evolution of a key innovation in phage lambda," Science, (Jan. 2012), vol. 335, No. 6067; pp. 428-432.
Gupta et al., "Coliphage K5, specific for *E. coli* exhibiting the capsular K5 antigen," FEMS Microbiol. Lett., (May 1982), vol. 14, No. 1; pp. 75-78.
Gross, et al., "Isolation of bacteriophages specific for the K1 polysaccharide antigen of *Escherichia coli*," J. Clin. Microbiol., (Dec. 1977), vol. 6, No. 6; pp. 548-550.
Schwarzer et al., "A Multivalent Adsorption Apparatus Explains the Broad Host Range of Phage phi92: a Comprehensive Genomic and Structural Analysis," J. Virol., (Oct. 2012), vol. 86, No. 19; pp. 10384-10398.
Tétart et al., "Bacteriophage T4 host range is expanded by duplications of a small domain of the tail fiber adhesin," J. Mol. Biol., (May 1996), vol. 258, No. 5; pp. 726-731.
Haggåard-Ljungquist, et al., "DNA sequences of the tail fiber genes of bacteriophage P2: evidence for horizontal transfer of tail fiber genes among unrelated bacteriophages.," J. Bacteriol., (Mar. 1992), vol. 174, No. 5; pp. 1462-1477.
Wu, et al., "Characterization of Extended-Host-Range Pseudo-T-Even Bacteriophage Kpp95 Isolated on Klebsiella pneumoniae," Appl. Environ. Microbiol., (Apr. 2007), vol. 73, No. 8; pp. 2532-2540.
Montag et al., "A component of the side tail fiber of *Escherichia coli* bacteriophage lambda can functionally replace the receptor-recognizing part of a long tail fiber protein of the unrelated bacteriophage T4," J. Bacteriol., (Aug. 1989), vol. 171, No. 8; pp. 4378-4384.

(Continued)

*Primary Examiner* — Robert M Kelly
(74) *Attorney, Agent, or Firm* — Carter, DeLuca & Farrell LLP

(57) ABSTRACT

The present disclosure relates generally to bacterial delivery vehicles for use in efficient transfer of a desired payload into a target bacterial cell. More specifically, the present disclosure relates to bacterial delivery vehicles with desired host ranges based on the presence of a chimeric receptor binding protein (RBP) composed of a fusion between the N-terminal region of a RBP derived from a lambda-like bacteriophage and the C-terminal region of a different RBP.

21 Claims, 15 Drawing Sheets

Specification includes a Sequence Listing.

(56) References Cited

PUBLICATIONS

Vimr, et al., "Use of prokaryotic-derived probes to identify poly(sialic acid) in neonatal neuronal membranes," Proc. Natl. Acad. Sci., (Apr. 1984), vol. 81, No. 7; pp. 1971-1975.

Stummeyer, et al., "Crystal structure of the polysialic acid-degrading endosialidase of bacteriophage K1F," Nat. Struct. Mol. Biol., (Jan. 2005), vol. 12, No. 1; pp. 90-96.

Scholl et al., "*Escherichia coli* K1's Capsule Is a Barrier to Bacteriophage T7," Appl. Environ. Microbiol., (Aug. 2005), vol. 71, No. 8; pp. 4872-4874.

Jiang et al. "Multigene Editing in the *Escherichia coli* Genome via the CRISPR-Cas9 System," Appl. Environ. Microbiol., (Apr. 2015), vol. 81, No. 7; pp. 2506-2514.

Cronan, "Improved Plasmid-Based System for Fully Regulated Off-To-On Gene Expression in *Escherichia coli* Application to Production of Toxic Proteins," Plasmid, (Jan. 2013), vol. 69, No. 1; pp. 81-89.

Thompson et al., "The K5 Lyase KflA Combines a Viral Tail Spike Structure with a Bacterial Polysaccharide Lyase Mechanism," J. Biol. Chem., (Jul. 2010), vol. 285, No. 31; pp. 23963-23969.

Potter et al., "HMMER web server: 2018 update," Nucleic Acids Res., (Jul. 2018), vol. 46, No. W1; pp. W200-W204.

Xu et al., "Chaperone-protein interactions that mediate assembly of the bacteriophage lambda tail to the correct length," J. Mol. Biol., (Mar. 2014), vol. 426, No. 5; pp. 1004-1018.

Schwarzer et al., "Proteolytic Release of the Intramolecular Chaperone Domain Confers Processivity to Endosialidase F," J. Biol. Chem., (Apr. 2009), vol. 284, No. 14; pp. 9465-9474.

Gilbert et al., "Current understanding of the human microbiome," Nat. Med., (Apr. 2018), vol. 24, No. 4; pp. 392-400.

Nkamga et al., "Archaea: Essential inhabitants of the human digestive microbiota," Hum. Microbiome J., (Mar. 2017), vol. 3; pp. 1-8.

Scholl et al., "The Genome of Bacteriophage K1F, a T7-Like Phage That Has Acquired the Ability To Replicate on K1 Strains of *Escherichia coli*," J. Bacteriol (Dec. 2005), vol. 187, No. 24; pp. 8499-8503.

Keen, "Tradeoffs in bacteriophage life histories," Bacteriophage, (Apr. 2014), vol. 4, No. 2; p. e28365.

Mirzaei et al., "Isolation of Phages for Phage Therapy: A Comparison of Spot Tests and Efficiency of Plating Analyses for Determination of Host Range and Efficacy," PLOS ONE, (Mar. 2015), vol. 10, No. 3; p. e0118557.

Goodridge et al., "Morphological, Host Range, and Genetic Characterization of Two Coliphages," Appl. Environ. Microbiol. (Sep. 2003), vol. 69, No. 9; pp. 5364-5371.

Ochman et al., "Standard reference strains of *Escherichia coli* from natural populations," J. Bacteriol, (Feb. 1984), vol. 157, No. 2; pp. 690-693.

McBurney et al., "Establishing What Constitutes a Healthy Human Gut Microbiome: State of the Science, Regulatory Considerations, and Future Directions," J. Nutr. (Nov. 2019), vol. 149, No. 11; pp. 1882-1895.

Nagpal et al., "Gut microbiome and aging: Physiological and mechanistic insights," Nutr. Healthy Aging (2018), vol. 4, No. 4; pp. 267-285.

Singh et al., "Influence of diet on the gut microbiome and implications for human health," J. Transl. Med. (Apr. 2017), vol. 15; pp. 1-17.

Tenaillon et al., "The population genetics of commensal *Escherichia coli*," Nat. Rev. Microbiol., (Mar. 2010), vol. 8, No. 3; pp. 207-217.

Nowrouzian et al., "*Escherichia coli* strains belonging to phylogenetic group B2 have superior capacity to persist in the intestinal microflora of infants," J. Infect. Dis., (Apr. 2005), vol. 191, No. 7; pp. 1078-1083.

Smati et al., "Quantitative analysis of commensal *Escherichia coli* populations reveals host-specific enterotypes at the intra-species level," MicrobiologyOpen (Aug. 2015), vol. 4, No. 4; pp. 604-615.

Hyman, "Phages for Phage Therapy: Isolation, Characterization, and Host Range Breadth," Pharmaceuticals, (Mar. 2019), vol. 12, No. 1; pp. 1-23.

Pantucek et al., "The polyvalent staphylococcal phage phi 812: its host-range mutants and related phages," Virology (Jul. 1998), vol. 246, No. 2; pp. 241-252.

Ross et al., "More Is Better: Selecting for Broad Host Range Bacteriophages," Front. Microbiol. (Sep. 2016), vol. 7; Article 1352; pp. 1-6.

Marusich et al., "Chaperones in bacteriophage T4 assembly," Biochem. Biokhimiia, (Apr. 1998), vol. 63, No. 4; pp. 399-406 (Abstract Only).

Golomidova et al., "Branched Lateral Tail Fiber Organization in T5-Like Bacteriophages DT57C and DT571/2 is Revealed by Genetic and Functional Analysis," Viruses, (Jan. 2016), vol. 8, No. 26; pp. 1-21.

Chen et al., "Crystal structure of ORF210 from *E. coli* O157:H1 phage CBA120 (TSP1), a putative tailspike protein," PloS One, (2014), vol. 9, No. 3; pp. e93156, 2014.

Kutter et al., "Characterization of a Vil-like phage specific to *Escherichia coli* O157:H7," Virology Journal (2011), vol. 8, No. 430; pp. 1-14 (PubMed—NCBI. [Online]. Available: https://www.ncbi.nlm.nih.gov/pubmed/21899740).

Arumugam et al., Enterotypes of the human gut microbiom, Nature (May 2011), vol. 473, No. 7346; pp. 174-180.

Kapitan et al., "Fungi as Part of the Microbiota and Interactions with Intestinal Bacteria," Current Topics in Microbiology and Immunology, (2019), vol. 422; pp. 265-301.

\* cited by examiner

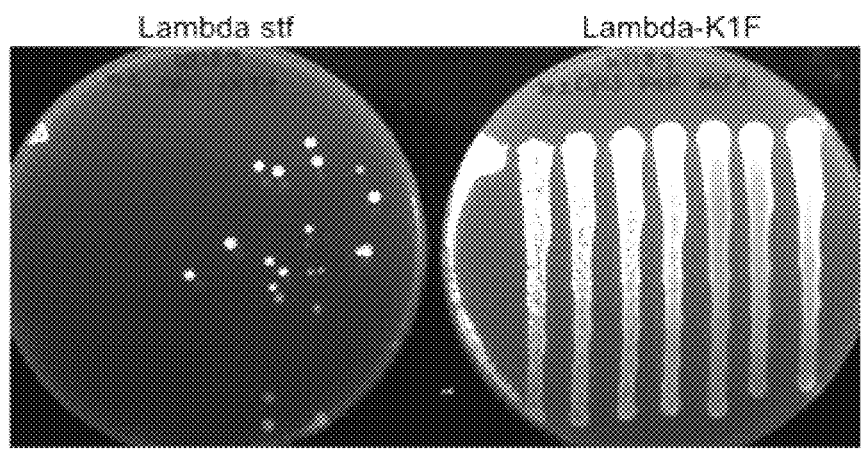
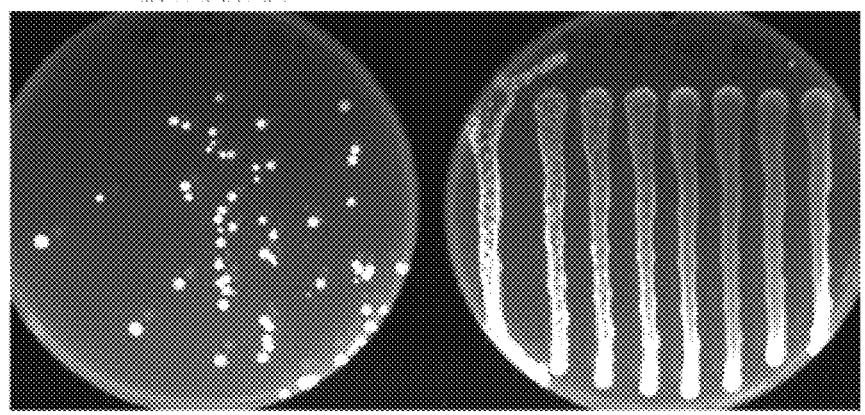
FIG. 2

FIG. 5A-C

CHIMERIC RECEPTOR BINDING PROTEINS FOR USE IN BACTERIAL DELIVERY VEHICLES

CROSS-REFERENCE TO RELATED APPLICATION

This application is a continuation application of U.S. patent application Ser. No. 16/696,769, filed Nov. 26, 2019, which claims benefit and priority to U.S. Provisional Application No. 62/771,761, filed Nov. 27, 2018; and U.S. Provisional Application No. 62/802,777, filed Feb. 8, 2019, which are both incorporated herein by reference in their entireties.

REFERENCE TO SEQUENCE LISTING SUBMITTED VIA EFS-WEB

This application includes an electronically submitted sequence listing in .txt format. The .txt file contains a sequence listing entitled "2643-3 US TRK-1_ST25.txt" created on Mar. 9, 2020 and is 940,581 bytes in size. The sequence listing contained in this .txt file is part of the specification and is hereby incorporated by reference herein in its entirety.

TECHNICAL FIELD

The present disclosure relates generally to bacterial delivery vehicles for use in efficient transfer of a desired payload into a target bacterial cell. More specifically, the present disclosure relates to bacterial delivery vehicles with desired host ranges based on the presence of a chimeric receptor binding protein (RBP) composed of a fusion between the N-terminal region of a RBP derived from a lambda-like, or lambda bacteriophage and the C-terminal region of a different RBP.

BACKGROUND

Bacteriophages are parasites that infect and multiply in bacteria. In general, the infection process can be divided in several stages: (i) adsorption corresponding to recognition and binding to the bacterial cell; (ii) injection of the DNA genome into the bacterial cell cytoplasm; (iii) production of a set of viral proteins that can lead to insertion in the host target genome (lysogenic phages) or to the production of infective particles (lytic phages) and (iv) release of mature virions from the infected cell, usually by controlled lysis [1].

Being the first step necessary for a successful infection, recognition and binding to the target cell is an essential process in the bacteriophage life cycle. Bacteriophages can in some cases recognize several strains of the same species, having a "broad host range", but very commonly are able to recognize a specific antigen present only on some strains of the same species [2]. It is thus not surprising that this step of the infection process is central in the competition between bacteriophage and bacteria for successful infection.

As a general mechanism, a bacteriophage encodes two main sets of proteins that are involved in the recognition process. The first set is able to attach to the bacteriophage's primary receptor on the cell surface, an event that triggers DNA ejection into the cytoplasm and is usually viewed as an "irreversible" binding process [3]. Different bacteriophage genera differ in the organization of this set of proteins, and hence the naming can be different. In some Siphovirus, for example, they are called the "central tail fiber" or "tail tip", which binds irreversibly to the LamB receptor in *Escherichia coli*. In the siphoviridae lambda, the "central tail fiber" or "tail tip" is composed of the protein gpJ [4]. In some other Siphovirus, like T5, a protein located at the very tip of the tail mediates this process. In the case of T5, a protein called pb5 recognizes the FhuA receptor [5]. This type of protein can be found in many other bacteriophages. In Myoviruses, like T4, the irreversible binding to the primary receptor or to the cell surface in general is mediated by the "short tail fibers", which are also located at the end of the tail tube [5].

The second set of proteins in the bacteriophage (herein referred to as "receptor binding proteins") encodes recognition and binding activities to the so-called "secondary receptor" on the bacterium. This secondary receptor allows for transient binding of the phage particle on the cell surface in order to scan the surface and position the first set of proteins in contact with the primary receptor. Since this binding is reversible, it allows the phage to "walk" on the cell surface until a primary receptor is found and the infection process starts. These protein complexes are sometimes referred to as "L-shape fibers", such as in T5, "side tail fibers" such as in lambda, "long tail fibers" as in T4, or tail spikes such as in phage P22 [5]-[8]. For some phages, the presence of this second set of proteins is necessary for the infection process to occur, such as T4 [5]. In some other phages, like lambda, this second set of proteins is not strictly necessary for the infection process to happen, but it may allow for a more efficient binding to the target cell [7].

Since the adsorption process is strictly necessary for a successful infection to happen, bacteria can develop multiple ways to avoid being recognized by a bacteriophage. For example, they can mutate the primary or secondary receptor to which the bacteriophage binds; they can mask this receptor by attaching proteins to it (receptor masking); or they can grow physical barriers around them in the form of bacterial capsules, thus blocking any access to the cell surface [9]. Bacteria can produce many different types of extracellular polymeric capsules [10]. In turn, bacteriophages have evolved different strategies to bypass these defense mechanisms. For instance, mutating the tail tip proteins allows them to use a different receptor [11]. However, the presence of a polymeric capsule around the bacterium requires a different approach, as it blocks all contact to any receptors on the cell surface. In these cases, bacteriophages have evolved specific proteins that can enzymatically degrade this capsule to gain access to the cells. These depolymerase activities are encoded in protein complexes that are distinct to the primary receptor recognition machinery, in the form of side tail fibers, long tail fibers or tailspikes [12], [13], [14].

The concept of a bacteriophage's host range needs to be redefined when only the adsorption and injection processes are taken into account. Since all incompatibilities or defense mechanisms related to the phage replication cycle are left out of the picture, the "adsorption host range" of a given phage is usually larger than the "classical host range" in which the infectious cycle leads to newly produced mature virions. The concept of host range becomes even more different to the classical definition when packaged phagemids based on a given bacteriophage capsid is used. Packaged phagemids do not contain the information necessary to replicate the viral particles, because they do not package their cognate viral genome. Thus, the host range of a packaged phagemid tends to be larger than that of the parental bacteriophage it derives from. Therefore, for development of novel bacterial delivery vehicles, designed for the efficient delivery of exogenous DNA payload into target strains, it is of utmost importance to be able to engineer delivery vehicles with desired host ranges as well as the ability to bypass bacterial mechanisms that can lead to unsuccessful binding of the packaged phagemid to the bacterial cell surface.

SUMMARY

As a general mechanism, a bacteriophage encodes sets of proteins that are involved in the bacterial cell recognition process. Described herein are novel approaches to engineering synthetic bacterial delivery vehicles with desired target host ranges. In some aspects, synthetic bacterial delivery vehicles are provided that are characterized by a chimeric receptor binding protein (RBP), wherein the chimeric RBP comprises a fusion between an N-terminal domain of a RBP from a lambda-like bacteriophage, or lambda bacteriophage, and a C-terminal domain of a different bacteriophage RBP. Such bacteriophage RBPs, from which the chimeric RBP are derived, include, for example, and depending on phages families, "L-shape fibers", "side tail fibers (stfs)", "long tail fibers" or "tailspikes." As disclosed herein, it has been demonstrated that a significant portion of a lambda-like bacteriophage receptor binding protein (RBP), such as a stf protein, can be exchanged with a portion of a different RBP. Moreover, specific fusion positions in the RBPs have been identified which allow one to obtain functional chimeric RBPs.

The chimeric receptor binding protein (RBP) is one wherein the chimeric RBP comprises a fusion between an N-terminal domain of a RBP derived from a lambda-like bacteriophage, or lambda bacteriophage, and a C-terminal domain of a different RBP wherein said N-terminal domain of the RBP is fused to said C-terminal domain of a different RBP within one of the amino acids regions selected from positions 1-150, 320-460, or 495-560 of the N-terminal RBP with reference to the lambda stf sequence (SEQ ID NO: 1) or a similar region of a RBP having homology with one or more of three amino acid regions ranging from positions 1-150, 320-460, and 495-560 of the RBP with reference to the lambda stf sequence. In one specific aspect of the invention, the different RBP domain of the chimeric receptor binding protein (RBP) is derived from any bacteriophage or from any bacteriocin.

In one specific aspect, the RBP from the lambda-like bacteriophage, or the lambda bacteriophage, or the different RBP contains homology in one or more of three amino acid regions ranging from positions 1-150, 320-460, and 495-560 of the RBP with reference to the lambda bacteriophage stf sequence (SEQ ID NO: 1). In certain aspects, the homology between the lambda-like bacteriophage, the lambda bacteriophage, or the different RBP and the one or more of three amino acids regions is around 35% identity for 45 amino acids or more, around 50% identify for 30 amino acids or more, and around 90% identity for 18 amino acids or more with reference to the lambda bacteriophage stf sequence (SEQ ID NO:1). Determination of homology can be performed using alignment tools such as the Smith-Waterman algorithm (Smith et al., 1981, J. Mol. Biol 147:195-197) or EMBOSS Matcher (Rice, Longden, Bleasby 2000 EMBOSS Trends in Genetics 16: 276-277).

In one aspect of the invention, the chimeric RBP comprises the N-terminal domain of a RBP fused to the C-terminal domain of a different RBP within one of the amino acid regions selected from positions 80-150, 320-460, or 495-560 of the N-terminal RBP with reference to the lambda bacteriophage stf sequence (SEQ ID NO:1). In another embodiment of the invention, the chimeric RBP comprises an N-terminal domain and a C-terminal domain fused within one of the amino acids regions selected from positions 1-150, 320-460 or 495-560 at an insertion site having at least 80% identity with an insertion site selected from the group consisting of amino acids SAGDAS (SEQ ID NO: 248), ADAKKS (SEQ ID NO: 249), MDETNR (SEQ ID NO: 250), SASAAA (SEQ ID NO: 251) and, GAGENS (SEQ ID NO: 252).

In another aspect, the chimeric RBP comprises the N-terminal domain of a RBP fused to the C-terminal domain of different RBP wherein the different RBP is a protein or group a different proteins that confers an altered host range. In one embodiment, the different RBP is a T4-like or T4 long tail fiber composed of a proximal tail fiber and a distal tail fiber (DTF), and the C-terminal domain of a T4-like or T4 RBP is the distal tail fiber (DTF). In another embodiment, the N-terminal domain of a RBP is fused to the T4-like or T4 distal tail fiber at an insertion site within the T4-like or T4 DTF having at least 80% identity with an insertion site selected from the group consisting of amino acids ATLKQI (SEQ ID NO: 253), IIQLED (SEQ ID NO: 254), GNIIDL (SEQ ID NO: 255), IATRV (SEQ ID NO: 256), TPGEL (SEQ ID NO: 257), GAIIN (SEQ ID NO: 258), NQIID (SEQ ID NO: 259), GQIVN (SEQ ID NO: 260) and, VDRAV (SEQ ID NO: 261). In a specific embodiment, the N-terminal domain of a RBP is fused to the T4-like or T4 distal tail fiber within a region from amino acid 1 to 90, with a preferred region from amino acid 40 to 50 of the DTF.

In specific embodiments, the disclosure provides specific chimeric RBPs. SEQ ID NOS 2-61, 123-153, 216-244 and 246-247 disclose the amino acid sequences of such chimeric RBPs as well as, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 123-129, 130, 131, 132, 135, 138, 139, 142, 145, 148, 151, 216, 219, 221, 223, 227, 230, 232, 234, 236, 238, 240, 243, 245 or 246.

In another aspect, the present disclosure provides nucleotide sequences encoding for the chimeric RBPs disclosed herein. In a specific embodiment, nucleic acids encoding such chimeric RBPs, as well as their corresponding AP proteins, are depicted in SEQ ID NOS 62-120, 122, 154-177, 182-210 and 212-213. In a specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 154, 155, 156, 159, 162, 163, 166, 169, 172 175, 182, 187, 189, 193, 196, 198, 200, 202, 204, 206, 209 or 212.

In one specific non-limiting aspect of the invention, it has been demonstrated that engineering the chimeric RBP to encode depolymerase activity can dramatically increases the delivery efficiency of the provided bacterial delivery vehicles comprising the chimeric RBP disclosed herein. In an embodiment of the invention, the different RBP domain of the chimeric RPB comprises depolymerase activity against an encapsulated bacterial strain. In a specific embodiment, the depolymerase is an endosialidase such as, for example, a K1F or K5 endosialidase.

In an embodiment of the invention, nucleic acid molecules encoding the chimeric RBPs disclosed herein are provided. Such nucleic acids may be included in vectors such as bacteriophages, plasmids, phagemids, viruses, and other vehicles which enable transfer and expression of the chimeric RBP encoding nucleic acids.

Bacterial delivery vehicles are provided which enable transfer of a nucleic acid payload, encoding a protein or nucleic acid of interest, into a desired target bacterial host cell. Such bacterial delivery vehicles are characterized by having a chimeric RBP comprising a fusion between the N-terminal domain of a RBP from a lambda-like bacteriophage, or lambda bacteriophage, and the C-terminal domain of a different RBP. In an embodiment of the invention, the bacterial delivery vehicles contain a chimeric RBP comprising a fusion between an N-terminal domain of a RBP derived from a lambda-like bacteriophage, or lambda bacteriophage, and a C-terminal domain of a different RBP wherein said N-terminal domain of the chimeric RBP is fused to said C-terminal domain of a different RBP within one of the amino acids regions selected from positions 1-150, 320-460, or 495-560 of the N-terminal domain with reference to the lambda stf sequence (SEQ ID NO: 1). In one aspect, the RBP from the lambda-like bacteriophage, the lambda bacteriophage, and the different RBP contain homology in one or more of three amino acids regions ranging from positions 1-150, 320-460, and 495-560 of the RBP with reference to the lambda bacteriophage stf sequence (SEQ ID NO: 1). In certain aspects, the homology is around 35% identity for 45 amino acids or more, around 50% identify for 30 amino acids or more, or around 90% identity for 18 amino acids or more within the one or more of three amino acids regions ranging from positions 1-150, 320-460, and 495-560 of the RBP with reference to the lambda bacteriophage stf sequence. In one specific aspect of the invention, the different RBP domain of the chimeric receptor binding protein (RBP) is derived from a bacteriophage or a bacteriocin. In one aspect of the invention, the chimeric RBP comprises an N-terminal domain of a RBP fused to a C-terminal domain of a RBP within one of the amino acids regions selected from positions 80-150, 320-460, or 495-560 of the N-terminal RBP domain with reference to the lambda stf sequence. In another embodiment of the invention, the chimeric RBP comprises an N-terminal domain of a RBP and a C-terminal domain of a RBP fused within a site of the N-terminal RBP domain having at least 80% identity with a site selected from the group consisting of amino acids SAGDAS (SEQ ID NO: 248), ADAKKS (SEQ ID NO: 249), MDETNR (SEQ ID NO: 250), SASAAA (SEQ ID NO: 251), and GAGENS (SEQ ID NO: 252).

In specific embodiments, the disclosure provides a bacterial delivery vehicle comprising a chimeric RBP. SEQ ID NOS 2-61, 123-153, 216-244 and 246-247 disclose the amino acid sequences of such chimeric RBPs and in addition, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 130, 131, 132, 135, 138, 139, 142, 145, 148, 151, 216, 219, 221, 223, 227, 230, 232, 234, 236, 238, 240, 243, 245 or 246.

In one aspect, the present disclosure also provides nucleotide sequences encoding for the chimeric RBPs disclosed herein. In a specific embodiment, nucleic acids encoding such chimeric RBPs, as well as corresponding AP proteins, are depicted in SEQ ID NOS 62-120, 122, 154-177, 182-210 and 212-213. In a specific embodiment, the nucleic acids encoding such chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 154, 155, 156, 159, 162, 163, 166, 169, 172, 175, 182, 185, 187, 189, 193, 196, 198, 200, 202, 204, 206, 209 or 212.

In other specific embodiments and to increase the delivery efficiency of the bacterial delivery vehicles disclosed herein the different RBP domain of the chimeric RBP comprises a domain having depolymerase activity against an encapsulated bacterial strain. In a specific embodiment, the depolymerase is an endosialidase, such as for example, a K1F or K5 endosialidase.

The bacterial delivery vehicles provided herein enable transfer of a nucleic acid payload, encoding one or more protein or nucleic acid of interest, into a desired target bacterial host cell. In certain embodiments of the invention, the nucleic acid of interest is selected from the group consisting of a Cas nuclease gene, a Cas9 nuclease gene, a guide RNA, a CRISPR locus, a toxin gene, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor, and a gene expressing a virulence protein or a virulence factor, or any of their combination. In an embodiment of the invention, the nucleic acid payload encodes a therapeutic protein. In another embodiment, the nucleic acid payload encodes an anti-sense nucleic acid molecule. In some embodiment, the nucleic acid payload encodes 2 nucleic acid of interest, one being a nuclease gene, for instance a Cas nuclease gene, and one being any other nucleic acid of interest. In one aspect, the bacterial delivery vehicle enables the transfer of a nucleic acid payload that encodes a nuclease that targets cleavage of a host bacterial cell genome or a host bacterial cell plasmid. In some aspects, the cleavage occurs in an antibiotic resistant gene. In another embodiment of the invention, the nuclease mediated cleavage of the host bacterial cell genome is designed to stimulate a homologous recombination event for insertion of a nucleic acid of interest into the genome of the bacterial cell.

The present invention also provides pharmaceutical or veterinary compositions comprising one or more of the bacterial delivery vehicles disclosed herein and a pharmaceutically-acceptable carrier. Also provided is a method for treating a bacterial infection comprising administering to a subject having a bacterial infection in need of treatment the provided pharmaceutical or veterinary composition. A method for reducing the amount of virulent and/or antibiotic resistant bacteria in a bacterial population is provided comprising contacting the bacterial population with the bacterial delivery vehicles disclosed herein.

BRIEF DESCRIPTION OF FIGURES

In order to better understand the subject matter that is disclosed herein and to exemplify how it may be carried out in practice, embodiments will now be described, by way of non-limiting example, with reference to the accompanying drawings. With specific reference to the drawings, it is stressed that the particulars shown are by way of example and for purposes of illustrative discussion of embodiments of the invention FIG. 1 demonstrates delivery in wild-type *E. coli* strains with lambda and OMPF-lambda packaged phagemids. Lambda packaged phagemids were diluted 1:5 in LB plus 5 mM CaCl2) and 10 uL added in each well. 90 uL of cells grown to an OD600 of around 0.5 were then added to each phagemid-containing well, incubated for 30 min at 37° C.

and 10 uL spotted on LB-agar supplemented with chloramphenicol. Left panel, wild type lambda packaged phagemids; right panel, OMPF-lambda variant. Arrows show strains with modified delivery as compared to lambda wild-type.

FIG. 2 depicts wild-type lambda and lambda-stf-K1F chimeric delivery vehicles on K1+ strains. Lambda packaged phagemids were sequentially diluted 10× in LB plus 5 mM CaCl2 and 10 uL added in each well. Cells grown to an OD600 of around 0.5 were then added to each phagemid dilution, incubated for 30 min at 37° C. and 10 uL plated on LB supplemented with chloramphenicol. Top panel, strain UTI89; bottom panel, strain S88. Left plates, wild type lambda packaged phagemids; right plates, stf-K1F lambda packaged phagemids.

FIG. 5(A) Left panel, wild type lambda packaged phagemids; rest of panels, three different ADAKKS-stf variants. FIG. 5(B) Left panel, wild type lambda packaged phagemids; rest of panels, three different SASAAA-stf variants. FIG. 5(C) Left panel, wild type lambda packaged phagemids; rest of panels, three different MDETNR-stf variants. For all panels, arrows show strains with improved delivery efficiency as compared to lambda wild-type.

FIG. 12-1, FIG. 12-2, and FIG. 12-3 depicts raw dot titrations of delivery particles with chimeric stf in 40 human strains of the ECOR collection. Below each panel, the name of the chimeric stf. Above each dot, the 1-2 letter code used to identify strains in FIG. 13.

DETAILED DESCRIPTION

Figure 1:
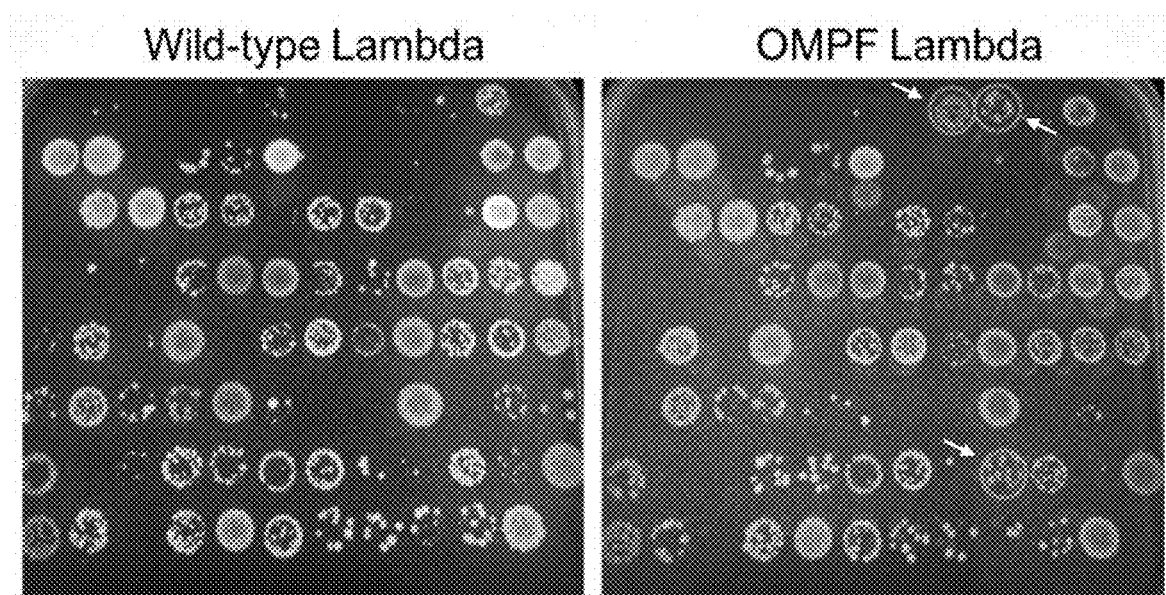

Disclosed herein are novel approaches to engineering synthetic bacterial delivery vehicles with desired target host ranges. The synthetic bacterial delivery vehicles are characterized by a chimeric receptor binding protein (RBP), wherein the chimeric RBP comprises a fusion between the N-terminal domain of a RBP from a lambda-like bacteriophage, or lambda bacteriophage, and the C-terminal domain of a different RBP. It has been demonstrated herein that a significant portion of a lambda-like RBP, such as a stf protein, can be exchanged with a portion of a different RBP. Moreover, specific fusion positions of the receptor binding protein have been identified which allow one to obtain a functional chimeric RBP.

As used herein, a receptor binding protein or RBP is a polypeptide that recognizes, and optionally binds and/or modifies or degrades a substrate located on the bacterial outer envelope, such as, without limitation, bacterial outer membrane, LPS, capsule, protein receptor, channel, structure such as the flagellum, pili, secretion system. The substrate can be, without limitation, any carbohydrate or modified carbohydrate, any lipid or modified lipid, any protein or modified protein, any amino acid sequence, and any combination thereof. As used herein, a lambda-like bacteriophage refers to any bacteriophage encoding a RBP having amino acids sequence homology of around 35% identity for 45 amino acids or more, around 50% identify for 30 amino acids or more, or around 90% identity for 18 amino acids or more in one or more of three amino acids regions ranging from positions 1-150, 320-460, and 495-560 with reference to the lambda bacteriophage stf sequence of SEQ ID NO: 1, independently of other amino acids sequences encoded by said bacteriophage.

The present disclosure provides a chimeric receptor binding protein (RBP), wherein the chimeric RBP comprises a fusion between an N-terminal domain of a RBP from a lambda-like bacteriophage, or lambda bacteriophage, and a C-terminal domain of a different bacteriophage RBP. Such bacteriophage RBPs, from which the chimeric RBP are derived, include, for example, "L-shape fibers", "side tail fibers (stfs)", "long tail fibers" or "tailspikes." As disclosed herein, it has been demonstrated that a significant portion of a lambda-like bacteriophage receptor binding protein (RBP), such as a stf protein, can be exchanged with a portion of a different RBP. Moreover, specific fusion positions in the RBPs have been identified which allow one to obtain a functional chimeric RBP. Such chimeric RBPs include those having an altered host range and/or biological activity such as, for example, depolymerase activity.

The chimeric receptor binding protein (RBP) is one wherein the chimeric RBP comprises a fusion between an N-terminal domain of a RBP derived from a lambda-like bacteriophage, or lambda bacteriophage, and a C-terminal domain of a different RBP wherein said N-terminal domain of the RBP is fused to said C-terminal domain of a different RBP within one of the amino acids regions selected from positions 1-150, 320-460, or 495-560 of the N-terminal RBP with reference to the lambda stf sequence (SEQ ID NO: 1) or a similar region of a RBP having homology with one or more of three amino acids regions ranging from positions 1-150, 320-460, and 495-560 of the RBP with reference to the lambda stf sequence. In one specific aspect of the invention, the different RBP of the chimeric receptor binding protein (RBP) is derived from any bacteriophage or from any bacteriocin.

In one specific aspect, the RBP from the lambda-like bacteriophage, the lambda bacteriophage, or the different RBP contain homology with one or more of three amino acids regions ranging from positions 1-150, 320-460, and 495-560 of the RBP with reference to the lambda bacteriophage stf sequence (SEQ ID NO:1). In certain aspects, the homology between the lambda-like bacteriophage, the lambda bacteriophage, or the different RBP and the one or more amino acids regions is around 35% identity for 45 amino acids or more, around 50% identify for 30 amino acids or more, and around 90% identity for 18 amino acids or more. Determination of homology can be performed using alignment tools such as the Smith-Waterman algorithm (Smith et al., 1981, J. Mol. Biol 147:195-197) or EMBOSS Matcher (Rice, Longden, Bleasby 2000 EMBOSS Trends in Genetics 16: 276-277). In one aspect of the invention, the chimeric RBP comprises the N-terminal domain of the chimeric RBP fused to the C-terminal domain of the chimeric RBP within one of the amino acids regions selected from positions 80-150, 320-460, or 495-560 with reference to the lambda bacteriophage stf sequence (SEQ ID NO: 1). In another embodiment of the invention, the chimeric RBP comprises an N-terminal domain and a C-terminal domain fused within one the three amino acids regions at an insertion site having at least 80% identity with an insertion site selected from the group consisting of amino acids SAGDAS (SEQ ID NO: 248), ADAKKS (SEQ ID NO: 249), MDETNR (SEQ ID NO: 250), SASAAA (SEQ ID NO: 251), and GAGENS (SEQ ID NO: 252).

In specific embodiments, the invention provides chimeric RBPs. SEQ ID NOS 2-61, 123-153, 216-244 and 246-247 disclose the amino acid sequences of such chimeric RBPs and in addition, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 130, 131, 132, 135, 138, 139, 142, 145, 148, 151, 216, 219, 221, 223, 227, 230, 232, 234, 236, 238, 240, 243, 245 or 246

In one aspect, the present disclosure also provides nucleotide sequences encoding for the chimeric RPBs disclosed herein. In a specific embodiment, nucleic acids encoding such chimeric RBPs, as well as corresponding AP proteins, are depicted in SEQ ID NOS 62-120, 122, 154-177, 182-210, 212-213. In a specific embodiment, the nucleic acids encoding the chimeric RBP comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 154, 155, 156, 159, 162, 163, 166, 169, 172, 175 182, 185, 187, 189, 193, 196, 198, 200, 202, 204, 206, 209 or 212.

In one specific non-limiting aspect of the invention, it has been demonstrated that engineering the chimeric RBP to encode depolymerase activity can dramatically increases the delivery efficiency of the provided bacterial delivery vehicles comprising the chimeric RBP disclosed herein. In an embodiment of the invention, the different RBP domain of the chimeric RPB comprises depolymerase activity against an encapsulated bacterial strain. In a specific embodiment, the depolymerase is an endosialidase such as, for example, a K1F or K5 endosialidase.

Nucleic acid molecules encoding the chimeric RBPs disclosed herein are provided. Such nucleic acids may be included in vectors such as bacteriophages, plasmids, phagemids, viruses, and other vehicles which enable transfer and expression of the chimeric RBP encoding nucleic acids.

Bacterial delivery vehicles are provided which enable transfer of a nucleic acid payload, encoding a protein or nucleic acid of interest, into a desired target bacterial host cell. Such bacterial delivery vehicles are characterized by having a chimeric RBP comprising a fusion between the N-terminal domain of a RBP from a lambda-like bacteriophage, or lambda bacteriophage, and the C-terminal domain of a different RBP. In an embodiment of the invention, the bacterial delivery vehicles contain a chimeric RBP comprising a fusion between an N-terminal domain of a RBP derived from a lambda-like bacteriophage, or lambda bacteriophage, and a C-terminal domain of a different RBP wherein said N-terminal domain of the chimeric RBP is fused to said C-terminal domain of a different RBP within one of the amino acids regions selected from positions 1-150, 320-460, or 495-560 of the N-terminal domain RBP with reference to the lambda stf sequence (SEQ ID NO: 1). In one aspect, the RBP from the lambda-like bacteriophage, the lambda bacteriophage, and the different RBP contain homology in one or more of three amino acids regions ranging from positions 1-150, 320-460, and 495-560 of the N-terminal RBP with reference to the lambda bacteriophage stf sequence (SEQ ID NO: 1). In certain aspects, the homology is around 35% identity for 45 amino acids or more, around 50% identify for 30 amino acids or more, or around 90% identity for 18 amino acids or more within the one or more of three amino acids regions ranging from positions 1-150, 320-460, and 495-560 of the N-terminal RBP with reference to the lambda bacteriophage stf sequence (SEQ ID NO: 1). In one specific aspect of the invention, the different RBP domain of the chimeric receptor binding protein (RBP) is derived from a bacteriophage or a bacteriocin. In one aspect of the invention, the chimeric RBP comprises an N-terminal domain of a RBP fused to a C-terminal domain of a RBP within one of the amino acids regions selected from 80-150, 320-460, or 495-560 of the RBPs with reference to the lambda stf sequence (SEQ ID NO: 1). In another embodiment of the invention, the chimeric RBP comprises an N-terminal domain of a RBP and a C-terminal domain of a RBP fused within a site of the N-terminal RBPs having at least 80% identity with a site selected from the group consisting of amino acids SAGDAS (SEQ ID NO. 248), ADAKKS (SEQ ID NO. 249), MDETNR (SEQ ID NO. 250), SASAAA (SEQ ID NO. 251), and GAGENS (SEQ ID NO. 252).

In specific embodiments, the disclosure provides a bacterial delivery vehicle comprising a chimeric RBP. SEQ ID NOS 2-61, 123-153, 216-244 and 246-247 disclose the amino acid sequences of such chimeric RBPs and in addition, in some instances, their corresponding natural chaperone proteins (designated "AP"). Such AP proteins assist in the folding of the chimeric RBPs. In a specific embodiment, the RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 130, 131, 132, 135, 138, 139, 142, 145, 148 151, 216, 219, 221, 223, 227, 230, 232, 234, 236, 238, 240, 243, 245 or 246

In one aspect, the present disclosure also provides nucleotide sequences encoding for the chimeric RPBs disclosed herein. In a specific embodiment, nucleic acids encoding such chimeric RBPs, as well as corresponding AP proteins, are depicted in SEQ ID NOS 62-120, 122, 154-177, 182-210, 212-213. In a specific embodiment, the nucleic acids encoding the chimeric RBPs comprise the nucleotide sequence of SEQ ID NO: 62, 64, 67, 69, 72, 75, 77, 80, 83, 84, 85, 87, 89, 91, 93, 95, 97, 99, 101, 102, 104, 106, 107, 108, 109, 110, 111, 112, 113, 116, 119, 154, 155, 156, 159, 162, 163, 166, 169, 172, 175, 182, 185, 187, 189, 193, 196, 198, 200, 202, 204, 206, 209 or 212.

In other specific embodiments and to increase the delivery efficiency of the bacterial delivery vehicles disclosed herein the different RBP domain of the chimeric comprises a domain having depolymerase activity against an encapsulated bacterial strain. In a specific embodiment, the depolymerase is an endosialidase, such as for example, a K1F or K5 endosialidase.

The bacterial delivery vehicles provided herein enable transfer of a nucleic acid payload, encoding a protein or nucleic acid of interest, into a desired target bacterial host cell. As used herein, the term "delivery vehicle" refers to any means that allows the transfer of a payload into a bacterium. There are several types of delivery vehicles encompassed by the present invention including, without limitation, bacteriophage scaffold, virus scaffold, chemical based delivery vehicle (e.g., cyclodextrin, calcium phosphate, cationic polymers, cationic liposomes), protein-based or peptide-based delivery vehicle, lipid-based delivery vehicle, nanoparticle-based delivery vehicles, non-chemical-based delivery vehicles (e.g., transformation, electroporation, sonoporation, optical transfection), particle-based delivery vehicles (e.g., gene gun, magnetofection, impalefection, particle bombardment, cell-penetrating peptides) or donor bacteria (conjugation).

Any combination of delivery vehicles is also encompassed by the present invention. The delivery vehicle can refer to a bacteriophage derived scaffold and can be obtained from a natural, evolved or engineered capsid. In some embodiments, the delivery vehicle is the payload as bacteria are naturally competent to take up a payload from the environment on their own.

As used herein, the term "payload" refers to any one or more nucleic acid sequence and/or amino acid sequence, or a combination of both (such as, without limitation, peptide nucleic acid or peptide-oligonucleotide conjugate) transferred into a bacterium with a delivery vehicle. The term "payload" may also refer to a plasmid, a vector or a cargo. The payload can be a phagemid or plasmid obtained from natural, evolved or engineered bacteriophage genome. The payload can also be composed only in part of phagemid or plasmid obtained from natural, evolved or engineered bacteriophage genome.

As used herein, the term "nucleic acid" refers to a sequence of at least two nucleotides covalently linked together which can be single-stranded or double-stranded or contains portion of both single-stranded and double-stranded sequence. Nucleic acids of the present invention can be naturally occurring, recombinant or synthetic. The nucleic acid can be in the form of a circular sequence or a linear sequence or a combination of both forms. The nucleic acid can be DNA, both genomic or cDNA, or RNA or a combination of both. The nucleic acid may contain any combination of deoxyribonucleotides and ribonucleotides, and any combination of bases, including uracil, adenine, thymine, cytosine, guanine, inosine, xathanine, hypoxathanine, isocytosine, 5-hydroxymethylcytosine and isoguanine. Other examples of modified bases that can be used in the present invention are detailed in Chemical Reviews 2016, 116 (20) 12655-12687. The term "nucleic acid" also encompasses any nucleic acid analogs which may contain other backbones comprising, without limitation, phosphoramide, phosphorothioate, phosphorodithioate, O-methylphophoroamidite linkage and/or deoxyribonucleotides and ribonucleotides nucleic acids. Any combination of the above features of a nucleic acid is also encompassed by the present invention.

Origins of replication known in the art have been identified from species-specific plasmid DNAs (e.g. ColE1, R1, pT181, pSC101, pMB1, R6K, RK2, p15a and the like), from bacterial virus (e.g. φX174, M13, F1 and P4) and from bacterial chromosomal origins of replication (e.g. oriC). In one embodiment, the phagemid according to the disclosure comprises a bacterial origin of replication that is functional in the targeted bacteria.

Alternatively, the plasmid according to the disclosure does not comprise any functional bacterial origin of replication or contain an origin of replication that is inactive in the targeted bacteria. Thus, the plasmid of the disclosure cannot replicate by itself once it has been introduced into a bacterium by the bacterial virus particle.

In one embodiment, the origin of replication on the plasmid to be packaged is inactive in the targeted bacteria, meaning that this origin of replication is not functional in the bacteria targeted by the bacterial virus particles, thus preventing unwanted plasmid replication.

In one embodiment, the plasmid comprises a bacterial origin of replication that is functional in the bacteria used for the production of the bacterial virus particles.

Plasmid replication depends on host enzymes and on plasmid-controlled cis and trans determinants. For example, some plasmids have determinants that are recognized in almost all gram-negative bacteria and act correctly in each host during replication initiation and regulation. Other plasmids possess this ability only in some bacteria (Kues, U and Stahl, U 1989 Microbiol Rev 53:491-516).

Plasmids are replicated by three general mechanisms, namely theta type, strand displacement, and rolling circle (reviewed by Del Solar et al. 1998 Microhio and Molec Biol. Rev 62:434-464) that start at the origin of replication. These replication origins contain sites that are required for interactions of plasmid and/or host encoded proteins.

Origins of replication used on the plasmid of the disclosure may be of moderate copy number, such as colE1 ori from pBR322 (15-20 copies per cell) or the R6K plasmid (15-20 copies per cell) or may be high copy number, e.g. pUC oris (500-700 copies per cell), pGEM oris (300-400 copies per cell), pTZ oris (>1000 copies per cell) or pBluescript oris (300-500 copies per cell).

In one embodiment, the bacterial origin of replication is selected in the group consisting of ColE1, pMB1 and variants (pBR322, pET, pUC, etc.), p15a, ColA, ColE2, pOSAK, pSC101, R6K, IncW (pSa etc.), IncFII, pT181, P1, F IncP, IncC, IncJ, IncN, IncP1, IncP4, IncQ, IncH11, RSF1010, CloDF13, NTP16, R1, f5, pPS10, pC194, pE194, BBR1, pBC1, pEP2, pWVO1, pLF1311, pAP1, pWKS1, pLS1, pLS11, pUB6060, pJD4, 0E01, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

More preferably, the bacterial origin of replication is a *E. coli* origin of replication selected in the group consisting of ColE1, pMB1 and variants (pBR322, pET, pUC, etc.), p15a, ColA, ColE2, pOSAK, pSC101, R6K, IncW (pSa etc.), IncFII, pT181, P1, F IncP, IncC, IncJ, IncN, IncP1, IncP4, IncQ, IncH11, RSF1010, CloDF13, NTP16, R1, f5 and pPS10.

More preferably, the bacterial origin of replication is selected in the group consisting of pC194, pE194, BBR1, pBC1, pEP2, pWVO1, pLF1311, pAP1, pWKS1, pLS1, pLS11, pUB6060, pJD4, 0E01, pSN22, pAMbeta1, pIP501, pIP407, ZM6100(Sa), pCU1, RA3, pMOL98, RK2/RP4/RP1/R68, pB10, R300B, pRO1614, pRO1600, pECB2, pCM1, pFA3, RepFIA, RepFIB, RepFIC, pYVE439-80, R387, phasyl, RA1, TF-FC2, pMV158 and pUB113.

Even more preferably, the bacterial origin of replication is ColE1.

The delivered nucleic acid sequence according to the disclosure may comprise a phage replication origin which can initiate, with complementation of a complete phage genome, the replication of the delivered nucleic acid sequence for later encapsulation into the different capsids.

A phage origin of replication comprised in the delivered nucleic acid sequence of the disclosure can be any origin of replication found in a phage.

Preferably, the phage origin of replication can be the wild-type or non-wildtype sequence of the M13, f1, φX174, P4, lambda, P2, lambda-like, HK022, mEP237, HK97, HK629, HK630, mEP043, mEP213, mEP234, mEP390, mEP460, mEPx1, mEPx2, phi80, mEP234, T2, T4, T5, T7, RB49, phiX174, R17, PRD1 P1-like, P2-like, P22, P22-like, N15 and N15-like bacteriophages.

More preferably, the phage origin of replication is selected in the group consisting of phage origins of replication of M13, f1, φX174, P4, and lambda.

In a particular embodiment, the phage origin of replication is the lambda or P4 origin of replication.

The delivered nucleic acid of interest comprises a nucleic acid sequence under the control of a promoter. In certain embodiments of the invention, the nucleic acid of interest is selected from the group consisting of a Cas nuclease gene, a Cas9 nuclease gene, a guide RNA, a CRISPR locus, a toxin gene, a gene expressing an enzyme such as a nuclease or a kinase, a TALEN, a ZFN, a meganuclease, a recombinase, a bacterial receptor, a membrane protein, a structural protein, a secreted protein, a gene expressing resistance to an antibiotic or to a drug in general, a gene expressing a toxic protein or a toxic factor, and a gene expressing a virulence protein or a virulence factor, or any of their combination. In an embodiment of the invention, the nucleic acid payload encodes a therapeutic protein. In another embodiment, the nucleic acid payload encodes an anti-sense nucleic acid molecule. In some embodiment, the nucleic acid payload encodes 2 nucleic acids of interest, one being a nuclease gene, for instance a Cas nuclease gene, and one being any other nucleic acid of interest.

In one embodiment, the sequence of interest is a programmable nuclease circuit to be delivered to the targeted bacteria. This programmable nuclease circuit is able to mediate in vivo sequence-specific elimination of bacteria that contain a target gene of interest (e.g. a gene that is harmful to humans). Some embodiments of the present disclosure relate to engineered variants of the Type II CRISPR-Cas (Clustered Regularly Interspaced Short Palindromic Repeats-CRISPR-associated) system of *Streptococcus pyogenes*. Other programmable nucleases that can be used include other CRISPR-Cas systems, engineered TALEN (Transcription Activator-Like Effector Nuclease) variants, engineered zinc finger nuclease (ZFN) variants, natural, evolved or engineered meganuclease or recombinase variants, and any combination or hybrids of programmable nucleases. Thus, the engineered autonomously distributed nuclease circuits provided herein may be used to selectively cleave DNA encoding a gene of interest such as, for example, a toxin gene, a virulence factor gene, an antibiotic resistance gene, a remodeling gene or a modulatory gene (cf. WO2014124226).

Other sequences of interest, preferably programmable, can be added to the delivered nucleic acid sequence so as to be delivered to targeted bacteria. Preferably, the sequence of interest added to the delivered nucleic acid sequence leads to cell death of the targeted bacteria. For example, the nucleic acid sequence of interest added to the plasmid may encode holins or toxins.

Alternatively, the sequence of interest circuit added to the delivered nucleic acid sequence does not lead to bacteria death. For example, the sequence of interest may encode reporter genes leading to a luminescence or fluorescence signal. Alternatively, the sequence of interest may comprise proteins and enzymes achieving a useful function such as modifying the metabolism of the bacteria or the composition of its environment.

In a particular embodiment, the nucleic sequence of interest is selected in the group consisting of Cas9, a single guide RNA (sgRNA), a CRISPR locus, a gene expressing an enzyme such as a nuclease or a kinase, a TALEN, a ZFN, a meganuclease, a recombinase, a bacterial receptor, a membrane protein, a structural protein, a secreted protein, resistance to an antibiotic or to a drug in general, a gene expressing a toxic protein or a toxic factor and a gene expressing a virulence protein or a virulence factor.

In a particular embodiment, the delivered nucleic acid sequence according to the disclosure comprises a nucleic acid sequence of interest that encodes a bacteriocin, which can be a proteinaceous toxin produced by bacteria to kill or inhibit growth of other bacteria. Bacteriocins are categorized in several ways, including producing strain, common resistance mechanisms, and mechanism of killing. Such bacteriocin had been described from gram negative bacteria (e.g. microcins, colicin-like bacteriocins and tailocins) and from gram positive bacteria (e.g. Class I, Class II, Class III or Class IV bacteriocins).

In one embodiment, the delivered nucleic acid sequence according to the disclosure further comprises a sequence of interest encoding a toxin selected in the group consisting of microcins, colicin-like bacteriocins, tailocins, Class I, Class II, Class III and Class IV bacteriocins.

In a particular embodiment, the corresponding immunity polypeptide (i.e. anti-toxin) may be used to protect bacterial cells (Cotter et al., Nature Reviews Microbiology 11: 95, 2013, which is hereby incorporated by reference in its entirety) for delivered nucleic acid sequence production and encapsidation purpose but is absent in the pharmaceutical composition and in the targeted bacteria in which the delivered nucleic acid sequence of the disclosure is delivered.

In one aspect of the disclosure, the CRISPR system is included in the delivered nucleic acid sequence. The CRISPR system contains two distinct elements, i.e. i) an endonuclease, in this case the CRISPR associated nuclease (Cas or "CRISPR associated protein") and ii) a guide RNA. The guide RNA is in the form of a chimeric RNA which consists of the combination of a CRISPR (RNAcr) bacterial RNA and a RNAtracr (trans-activating RNA CRISPR) (Jinek et al., Science 2012). The guide RNA combines the targeting specificity of the RNAcr corresponding to the "spacing sequences" that serve as guides to the Cas proteins, and the conformational properties of the RNAtracr in a single transcript. When the guide RNA and the Cas protein are expressed simultaneously in the cell, the target genomic sequence can be permanently modified or interrupted. The modification is advantageously guided by a repair matrix. In general, the CRISPR system includes two main classes depending on the nuclease mechanism of action. Class 1 is made of multi-subunit effector complexes and includes type I, III and IV. Class 2 is made of single-unit effector modules, like Cas9 nuclease, and includes type II (II-A, II-B, II-C, II-C variant), V (V-A, V-B, V-C, V-D, V-E, V-U1, V-U2, V-U3, V-U4, V-U5) and VI (VI-A, VI-BLVI-B2, VI-C, VI-D)

The sequence of interest according to the present disclosure comprises a nucleic acid sequence encoding Cas protein. A variety of CRISPR enzymes are available for use as a sequence of interest on the plasmid. In some embodiments, the CRISPR enzyme is a Type II CRISPR enzyme. In some embodiments, the CRISPR enzyme catalyzes DNA cleavage. In some other embodiments, the CRISPR enzyme catalyzes RNA cleavage. In one embodiment, the CRISPR enzymes may be coupled to a sgRNA. In certain embodiments, the sgRNA targets a gene selected in the group consisting of an antibiotic resistance gene, virulence protein or factor gene, toxin protein or factor gene, a bacterial receptor gene, a membrane protein gene, a structural protein gene, a secreted protein gene and a gene expressing resistance to a drug in general.

Non-limiting examples of Cas proteins as part of a multi-subunit effector or as a single-unit effector include Cas1, Cas1B, Cas2, Cas3, Cas4, Cas5, Cash, Cas7, Cas8, Cas9 (also known as Csn1 and Csx12), Cas10, Cas11 (SS), Cas12a (Cpf1), Cas12b (C2c1), Cas12c (C2c3), Cas12d (CasY), Cas12e (CasX), C2c4, C2c8, C2c5, C2c10, C2c9, Cas13a (C2c2), Cas13b (C2c6), Cas13c (C2c7), Cas13d, Csa5, Csc1, Csc2, Cse1, Cse2, Csy1, Csy2, Csy3, Csf1, Csf2, Csf3, Csf4, Csm2, Csm3, Csm4, Csm5, Csm6, Cmr1, Cmr3, Cmr4, Cmr5, Cmr6, Csn2, Csb1, Csb2, Csb3, Csx17, Csx14, Csx10, Csx16, CsaX, Csx13, Csx1, Csx15, SdCpf1, CmtCpf1, TsCpf1, CmaCpf1, PcCpf1, ErCpf1, FbCpf1, UbcCpf1, AsCpf1, LbCpf1, homologues thereof, orthologues thereof, variants thereof, or modified versions thereof. In some embodiments, the CRISPR enzyme cleaves both strands of the target nucleic acid at the Protospacer Adjacent Motif (PAM) site.

In a particular embodiment, the CRISPR enzyme is any Cas9 protein, for instance any naturally-occurring bacterial Cas9 as well as any variants, homologs or orthologs thereof.

By "Cas9" is meant a protein Cas9 (also called Csn1 or Csx12) or a functional protein, peptide or polypeptide fragment thereof, i.e. capable of interacting with the guide RNA(s) and of exerting the enzymatic activity (nuclease) which allows it to perform the double-strand cleavage of the DNA of the target genome. "Cas9" can thus denote a modified protein, for example truncated to remove domains of the protein that are not essential for the predefined functions of the protein, in particular the domains that are not necessary for interaction with the gRNA (s).

The sequence encoding Cas9 (the entire protein or a fragment thereof) as used in the context of the disclosure can be obtained from any known Cas9 protein (Fonfara et al., Nucleic Acids Res 42 (4), 2014; Koonin et al., Nat Rev Microbiol 15(3), 2017). Examples of Cas9 proteins useful in the present disclosure include, but are not limited to, Cas9 proteins of *Streptococcus pyogenes* (SpCas9), *Streptococcus thermophiles* (St1Cas9, St3Cas9), *Streptococcus mutans*, *Staphylococcus aureus* (SaCas9), *Campylobacter jejuni* (CjCas9), *Francisella novicida* (FnCas9) and *Neisseria meningitides* (NmCas9).

The sequence encoding Cpf1 (Cas12a) (the entire protein or a fragment thereof) as used in the context of the disclosure can be obtained from any known Cpf1 (Cas12a) protein (Koonin et al., 2017). Examples of Cpf1 (Cas12a) proteins useful in the present disclosure include, but are not limited to, Cpf1(Cas12a) proteins of *Acidaminococcus* sp, *Lachnospiraceae bacteriu* and *Francisella novicida*.

The sequence encoding Cas13a (the entire protein or a fragment thereof) can be obtained from any known Cas13a (C2c2) protein (Abudayyeh et al., 2017). Examples of Cas13a (C2c2) proteins useful in the present disclosure include, but are not limited to, Cas13a (C2c2) proteins of *Leptotrichia wadei* (LwaCas13a).

The sequence encoding Cas13d (the entire protein or a fragment thereof) can be obtained from any known Cas13d protein (Yan et al., 2018). Examples of Cas13d proteins useful in the present disclosure include, but are not limited to, Cas13d proteins of *Eubacterium siraeum* and *Ruminococcus* sp.

In a particular embodiment, the nucleic sequence of interest is a CRISPR/Cas9 system for the reduction of gene expression or inactivation a gene selected in the group consisting of an antibiotic resistance gene, virulence factor or protein gene, toxin factor or protein gene, a gene expressing a bacterial receptor, a membrane protein, a structural protein, a secreted protein, and a gene expressing resistance to a drug in general.

In one embodiment, the CRISPR system is used to target and inactivate a virulence factor. A virulence factor can be any substance produced by a pathogen that alter host-pathogen interaction by increasing the degree of damage done to the host. Virulence factors are used by pathogens in many ways, including, for example, in cell adhesion or colonization of a niche in the host, to evade the host's immune response, to facilitate entry to and egress from host cells, to obtain nutrition from the host, or to inhibit other physiological processes in the host. Virulence factors can include enzymes, endotoxins, adhesion factors, motility factors, factors involved in complement evasion, and factors that promote biofilm formation. For example, such targeted virulence factor gene can be *E. coli* virulence factor gene such as, without limitation, EHEC-HlyA, Stx1 (VT1), Stx2 (VT2), Stx2a (VT2a), Stx2b (VT2b), Stx2c (VT2c), Stx2d (VT2d), Stx2e (VT2e) and Stx2f (VT2f), Stx2h (VT2h), fimA, fimF, fimH, neuC, kpsE, sfa, foc, iroN, aer, iha, papC, papGI, papGII, papGIII, hlyC, cnfl, hra, sat, ireA, usp ompT, ibeA, malX, fyuA, irp2, traT, afaD, ipaH, eltB, estA, bfpA, eaeA, espA, aaiC, aatA, TEM, CTX, SHV, csgA, csgB, csgC, csgD, csgE, csgF, csgG, csgH, T1SS, T2SS, T3SS, T4SS, T5SS, T6SS (secretion systems). For example, such targeted virulence factor gene can be *Shigella dysenteriae* virulence factor gene such as, without limitation, stx1 and stx2. For example, such targeted virulence factor gene can be *Yersinia pestis* virulence factor gene such as, without limitation, yscF (plasmid-borne (pCD1) T3 SS external needle subunit). For example, such targeted virulence factor gene can be *Francisella tularensis* virulence factor gene such as, without limitation, fs1A. For example, such targeted virulence factor gene can be *Bacillus anthracis* virulence factor gene such as, without limitation, pag (Anthrax toxin, cell-binding protective antigen). For example, such targeted virulence factor gene can be *Vibrio cholera* virulence factor gene such as, without limitation, ctxA and ctxB (cholera toxin), tcpA (toxin co-regulated pilus), and toxT (master virulence regulator). For example, such targeted virulence factor gene can be *Pseudomonas aeruginosa* virulence factor genes such as, without limitation, pyoverdine (e.g., sigma factor pvdS, biosynthetic genes pvdL, pvdl, pvdJ, pvdH, pvdA, pvdF, pvdQ, pvdN, pvdM, pvdO, pvdP, transporter genes pvdE, pvdR, pvdT, opmQ), siderophore pyochelin (e.g., pchD, pchC, pchB, pchA, pchE, pchF and pchG, and toxins (e.g., exoU, exoS and exoT). For example, such targeted virulence factor gene can be *Klebsiella pneumoniae* virulence factor genes such as, without limitation, fimA (adherence, type I fimbriae major subunit), and cps (capsular polysaccharide). For example, such targeted virulence factor gene can be *Acinetobacter baumannii* virulence factor genes such as, without limitation, ptk (capsule polymerization) and epsA (assembly). For example, such targeted virulence factor gene can be *Salmonella enterica Typhi* virulence factor genes such as, without limitation, MIA (invasion, SPI-1 regulator), ssrB (SPI-2 regulator), and those associated with bile tolerance, including efflux pump genes acrA, acrB and tolC. For example, such targeted virulence factor gene can be *Fusobacterium nucleatum* virulence factor genes such as, without limitation, FadA and TIGIT. For example, such targeted virulence factor gene can be *Bacteroides fragilis* virulence factor genes such as, without limitation, bft.

In another embodiment, the CRISPR/Cas9 system is used to target and inactivate an antibiotic resistance gene such as, without limitation, GyrB, ParE, ParY, AAC(1), AAC(2'), AAC(3), AAC(6'), ANT(2"), ANT(3"), ANT(4'), ANT(6), ANT(9), APH(2"), APH(3"), APH(3'), APH(4), APH(6), APH(7"), APH(9), ArmA, RmtA, RmtB, RmtC, Sgm, AER, BLA1, CTX-M, KPC, SHV, TEM, BlaB, CcrA, IMP, NDM, VIM, ACT, AmpC, CMY, LAT, PDC, OXA β-lactamase, mecA, Omp36, OmpF, PIB, bla (blaI, blaR1) and mec (mecI, mecR1) operons, Chloramphenicol acetyltransferase (CAT), Chloramphenicol phosphotransferase, Ethambutol-resistant arabinosyltransferase (EmbB), MupA, MupB, Integral membrane protein MprF, Cfr 23S rRNA methyltransferase, Rifampin ADP-ribosyltransferase (Arr), Rifampin glycosyltransferase, Rifampin monooxygenase, Rifampin phosphotransferase, DnaA, RbpA, Rifampin-resistant beta-subunit of RNA polymerase (RpoB), Erm 23S rRNA methyltransferases, Lsa, MsrA, Vga, VgaB, Streptogramin Vgb lyase, Vat acetyltransferase, Fluoroquinolone acetyltransferase, Fluoroquinolone-resistant DNA topoisomerases, Fluoroquinolone-resistant GyrA, GyrB, ParC, Quinolone resistance protein (Qnr), FomA, FomB, FosC, FosA, FosB, FosX, VanA, VanB, VanD, VanR, VanS, Lincosamide nucleotidyltransferase (Lin), EreA, EreB, GimA, Mgt, Ole, Macrolide phosphotransferases (MPH), MefA, MefE, Mel, Streptothricin acetyltransferase (sat), Sul1, Sul2, Sul3, sulfonamide-resistant FolP, Tetracycline inactivation enzyme TetX, TetA, TetB, TetC, Tet30, Tet31, TetM, TetO, TetQ, Tet32, Tet36, MacAB-TolC, MsbA, MsrA, VgaB, EmrD, EmrAB-TolC, NorB, GepA, MepA, AdeABC, AcrD, MexAB-OprM, mtrCDE, EmrE, adeR, acrR, baeSR, mexR, phoPQ, mtrR, or any antibiotic resistance gene described in the Comprehensive Antibiotic Resistance Database (CARD https://card.mcmaster.ca/).

In another embodiment, the CRISPR/Cas9 system is used to target and inactivate a bacterial toxin gene. Bacterial toxin can be classified as either exotoxins or endotoxins. Exotoxins are generated and actively secreted; endotoxins remain part of the bacteria. The response to a bacterial toxin can involve severe inflammation and can lead to sepsis. Such toxin can be for example Botulinum neurotoxin, Tetanus toxin, Staphylococcus toxins, Diphteria toxin, Anthrax toxin, Alpha toxin, Pertussis toxin, Shiga toxin, Heat-stable enterotoxin (*E. coli* ST), colibactin, BFT (*B. fragilis* toxin) or any toxin described in Henkel et al., (Toxins from Bacteria in EXS. 2010; 100: 1-29).

The bacteria targeted by bacterial delivery vehicles disclosed herein can be any bacteria present in a mammal organism. In a certain aspect, the bacteria are targeted through interaction of the chimeric RBPs expressed by the delivery vehicles with the bacterial cell. It can be any commensal, symbiotic or pathogenic bacteria of the microbiota or microbiome.

A microbiome may comprise of a variety of endogenous bacterial species, any of which may be targeted in accordance with the present disclosure. In some embodiments, the genus and/or species of targeted endogenous bacterial cells may depend on the type of bacteriophages being used for preparing the bacterial delivery vehicles. For example, some bacteriophages exhibit tropism for, or preferentially target, specific host species of bacteria. Other bacteriophages do not exhibit such tropism and may be used to target a number of different genus and/or species of endogenous bacterial cells.

Examples of bacterial cells include, without limitation, cells from bacteria of the genus *Yersinia* spp., *Escherichia* spp., *Klebsiella* spp., *Acinetobacter* spp., *Bordetella* spp., *Neisseria* spp., *Aeromonas* spp., *Franciesella* spp., *Corynebacterium* spp., *Citrobacter* spp., *Chlamydia* spp., *Hemophilus* spp., *Brucella* spp., *Mycobacterium* spp., *Legionella* spp., *Rhodococcus* spp., *Pseudomonas* spp., *Helicobacter* spp., *Vibrio* spp., *Bacillus* spp., *Erysipelothrix* spp., *Salmonella* spp., *Streptomyces* spp., *Streptococcus* spp., *Staphylococcus* spp., *Bacteroides* spp., *Prevotella* spp., *Clostridium* spp., *Bifidobacterium* spp., *Clostridium* spp., *Brevibacterium* spp., *Lactococcus* spp., *Leuconostoc* spp., *Actinobacillus* spp., *Selnomonas* spp., *Shigella* spp., *Zymonas* spp., *Mycoplasma* spp., *Treponema* spp., *Leuconostoc* spp., *Corynebacterium* spp., *Enterococcus* spp., *Enterobacter* spp., *Pyrococcus* spp., *Serratia* spp., *Morganella* spp., *Parvimonas* spp., *Fusobacterium* spp., *Actinomyces* spp., *Porphyromonas* spp., *Micrococcus* spp., *Bartonella* spp., *Borrelia* spp., *Brucelia* spp., *Campylobacter* spp., *Chlamydophilia* spp., *Cutibacterium* spp., *Propionibacterium* spp., *Gardnerella* spp., *Ehrlichia* spp., *Haemophilus* spp., *Leptospira* spp., *Listeria* spp., *Mycoplasma* spp., *Nocardia* spp., *Rickettsia* spp., *Ureaplasma* spp., and *Lactobacillus* spp, and a mixture thereof.

Thus, bacterial delivery vehicles may target (e.g., specifically target) a bacterial cell from any one or more of the foregoing genus of bacteria to specifically deliver the payload of interest according to the disclosure.

Preferably, the targeted bacteria can be selected from the group consisting of *Yersinia* spp., *Escherichia* spp., *Klebsiella* spp., *Acinetobacter* spp., *Pseudomonas* spp., *Helicobacter* spp., *Vibrio* spp, *Salmonella* spp., *Streptococcus* spp., *Staphylococcus* spp., *Bacteroides* spp., *Clostridium* spp., *Shigella* spp., *Enterococcus* spp., *Enterobacter* spp., *Listeria* spp., *Cutibacterium* spp., *Propionibacterium* spp., *Fusobacterium* spp., *Porphyromonas* spp. and *Gardnerella* spp.

In some embodiments, bacterial cells of the present disclosure are anaerobic bacterial cells (e.g., cells that do not require oxygen for growth). Anaerobic bacterial cells include facultative anaerobic cells such as but not limited to *Escherichia coli, Shewanella oneidensis, Gardnerella vaginalis* and *Listeria*. Anaerobic bacterial cells also include obligate anaerobic cells such as, for example, *Bacteroides, Clostridium, Cutibacterium, Propionibacterium, Fusobacterium* and *Porphyromona* species. In humans, anaerobic bacteria are most commonly found in the gastrointestinal tract. In some particular embodiment, the targeted bacteria are thus bacteria most commonly found in the gastrointestinal tract. Bacteriophages used for preparing the bacterial virus particles, and then the bacterial virus particles, may target (e.g., to specifically target) anaerobic bacterial cells according to their specific spectra known by the person skilled in the art to specifically deliver the plasmid.

In some embodiments, the targeted bacterial cells are, without limitation, *Bacteroides* thetaiotaomicron, *Bacteroides fragilis, Bacteroides distasonis, Bacteroides vulgatus, Clostridium leptum, Clostridium coccoides, Staphylococcus aureus, Bacillus subtilis, Clostridium butyricum, Brevibacterium lactofermentum, Streptococcus agalactiae, Lactococcus lactis, Leuconostoc lactis, Actinobacillus actinobycetemcomitans, cyanobacteria, Escherichia coli, Helicobacter pylori, Selnomonas ruminatium, Shigella sonnei, Zymomonas mobilis, Mycoplasma mycoides, Treponema denticola, Bacillus thuringiensis, Staphilococcus lugdunensis, Leuconostoc oenos, Corynebacterium xerosis, Lactobacillus plantarum, Lactobacillus rhamnosus, Lactobacillus casei, Lactobacillus acidophilus, Enterococcus faecalis, Bacillus coagulans, Bacillus cereus, Bacillus popillae, Synechocystis* strain PCC6803, *Bacillus liquefaciens, Pyrococcus abyssi, Selenomonas nominantium, Lactobacillus hilgardii, Streptococcus ferus, Lactobacillus pentosus, Bacteroides fragilis, Staphylococcus epidermidis, Streptomyces phaechromogenes, Streptomyces ghanaenis, Klebsiella pneumoniae, Enterobacter cloacae, Enterobacter aerogenes, Serratia marcescens, Morganella morganii, Citrobacter freundii, Propionibacterium freudenreichii, Pseudomonas aerigunosa, Parvimonas micra, Prevotella intermedia, Fusobacterium nucleatum, Prevotella nigrescens, Actinomyces israelii, Porphyromonas endodontalis, Porphyromonas gingivalis Micrococcus luteus, Bacillus megaterium, Aeromonas hydrophila, Aeromonas caviae, Bacillus anthracis, Bartonella henselae, Bartonella Quintana, Bordetella pertussis, Borrelia burgdorferi, Borrelia garinii, Borrelia afzelii, Borrelia recurrentis, Brucella abortus, Brucella canis, Brucella melitensis, Brucella suis, Campylobacter jejuni, Campylobacter coli, Campylobacter fetus, Chlamydia pneumoniae, Chlamydia trachomatis, Chlamydophila psittaci, Clostridium botulinum, Clostridium difficile, Clostridium perfringens, Clostridium tetani, Corynebacterium diphtheria, Cutibacterium acnes* (formerly *Propionibacterium acnes*), *Ehrlichia canis, Ehrlichia chaffeensis, Enterococcus faecium, Francisella tularensis, Haemophilus influenza, Legionella pneumophila, Leptospira interrogans, Leptospira santarosai, Leptospira weilii, Leptospira noguchii, Listeria monocytogenes, Mycobacterium leprae, Mycobacterium tuberculosis, Mycobacterium ulcerans, Mycoplasma pneumonia, Neisseria gonorrhoeae, Neisseria meningitides, Nocardia asteroids, Rickettsia rickettsia, Salmonella enteritidis, Salmonella typhi, Salmonella paratyphi, Salmonella typhimurium, Shigella flexnerii, Shigella dysenteriae, Staphylococcus saprophyticus, Streptococcus pneumoniae, Streptococcus pyogenes, Gardnerella vaginalis, Streptococcus viridans, Treponema pallidum, Ureaplasma urealyticum, Vibrio cholera, Vibrio parahaemolyticus, Yersinia pestis, Yersinia enterocolitica, Yersinia pseudotuberculosis, Actinobacter baumanii, Pseudomonas aerigunosa*, and a mixture thereof, preferably the bacteria of interest are selected from the group consisting of *Escherichia coli, Enterococcus faecium, Staphylococcus aureus, Klebsiella pneumoniae, Acinetobacter baumanii, Pseudomonas aeruginosa, Enterobacter cloacae*, and *Enterobacter aerogenes*, and a mixture thereof.

In one embodiment, the targeted bacteria are *Escherichia coli*.

Thus, bacteriophages used for preparing the bacterial delivery vehicles, and then the bacterial delivery vehicles, may target (e.g., specifically target) a bacterial cell from any one or more of the foregoing genus and/or species of bacteria to specifically deliver the plasmid.

In one embodiment, the targeted bacteria are pathogenic bacteria. The targeted bacteria can be virulent bacteria.

The targeted bacteria can be antibacterial resistance bacteria, preferably selected from the group consisting of extended-spectrum beta-lactamase-producing (ESBL) *Escherichia coli*, ESBL *Klebsiella pneumoniae*, vancomycin-resistant *Enterococcus* (VRE), methicillin-resistant *Staphylococcus aureus* (MRSA), multidrug-resistant (MDR) *Acinetobacter baumannii*, MDR *Enterobacter* spp., and a combination thereof. Preferably, the targeted bacteria can be selected from the group consisting of extended-spectrum beta-lactamase-producing (ESBL) *Escherichia coli* strains.

Alternatively, the targeted bacterium can be a bacterium of the microbiome of a given species, preferably a bacterium of the human microbiota.

The present disclosure is directed to bacterial delivery vehicle containing the payload as described herein. The bacterial delivery vehicles are prepared from bacterial virus. The bacterial delivery vehicles are chosen in order to be able to introduce the payload into the targeted bacteria.

Bacterial viruses, from which the bacterial delivery vehicles having chimeric receptor binding proteins may be derived, are preferably bacteriophages. Optionally, the bacteriophage is selected from the Order Caudovirales consisting of, based on the taxonomy of Krupovic et al, Arch Virol, 2015:

Bacteriophages may be selected from the family Myoviridae (such as, without limitation, genus Cp220virus, Cp8virus, Ea214virus, Felixo1virus, Mooglevirus, Suspvirus, Hp1virus, P2virus, Kayvirus, P100virus, Silviavirus, Spo1virus, Tsarbombavirus, Twortvirus, Cc31virus, Jd18virus, Js98virus, Kp15virus, Moonvirus, Rb49virus, Rb69virus, S16virus, Schizot4virus, Sp18virus, T4virus, Cr3virus, Se1virus, V5virus, Abouovirus, Agatevirus, Agrican357virus, Ap22virus, Arv1virus, B4virus, Bastillevirus, Bc431virus, Bcep78virus, Bcepmuvirus, Biquartavirus, Bxz1virus, Cd119virus, Cp51virus, Cvm10virus, Eah2virus, E1virus, Hapunavirus, Jimmervirus, Kpp10virus, M12virus, Machinavirus, Marthavirus, Msw3virus, Muvirus, Myohalovirus, Nit1virus, P1virus, Pakpunavirus, Pbunavirus, Phikzvirus, Rheph4virus, Rsl2virus, Rslunavirus, Secunda5virus, Sep1virus, Spn3virus, Svunavirus, Tg1virus, Vhm1virus and Wphvirus)

Bacteriophages may be selected from the family Podoviridae (such as, without limitation, genus Fri1virus, Kp32virus, Kp34virus, Phikmvvirus, Pradovirus, Sp6virus, T7virus, Cp1virus, P68virus, Phi29virus, Nona33virus, Pocjvirus, T12011virus, Bcep22virus, Bpp1virus, Cba41virus, Dfl12virus, Ea92virus, Epsilon15virus, F116virus, G7cvirus, Jwalphavirus, Kf1virus, Kpp25virus, Lit1virus, Luz24virus, Luz7virus, N4virus, Nonanavirus, P22virus, Pagevirus, Phieco32virus, Prtbvirus, Sp58virus, Una961virus and Vp5virus) Bacteriophages may be selected from the family Siphoviridae (such as, without limitation, genus Camvirus, Likavirus, R4virus, Acadianvirus, Coopervirus, Pg1virus, Pipefishvirus, Rosebushvirus, Brujitavirus, Che9cvirus, Hawkeyevirus, Plotvirus, Jerseyvirus, Klgvirus, Sp31virus, Lmd1virus, Una4virus, Bongovirus, Reyvirus, Buttersvirus, Charlievirus, Redivirus, Baxtervirus, Nymphadoravirus, Bignuzvirus, Fishburnevirus, Phayoncevirus, Kp36virus, Rogue1virus, Rtpvirus, T1virus, T1svirus, Abl8virus, Amigovirus, Anatolevirus, Andromedavirus, Attisvirus, Barnyardvirus, Bernal13virus, Biseptimavirus, Bronvirus, C2virus, C5virus, Cba181virus, Cbastvirus, Cecivirus, Che8virus, Chivirus, Cjw1virus, Corndogvirus, Cronusvirus, D3112virus, D3virus, Decurrovirus, Demosthenesvirus, Doucettevirus, E125virus, Eiauvirus, Ff47virus, Gaiavirus, Gilesvirus, Gordonvirus, Gordtnkvirus, Harrisonvirus, Hk578virus, Hk97virus, Jenstvirus, Jwxvirus, Kellezivirus, Korravirus, L5virus, lambdavirus, Laroyevirus, Liefievirus, Marvinvirus, Mudcatvirus, N15virus, Nonagvirus, Np1virus, Omegavirus, P12002virus, P12024virus, P23virus, P70virus, Pa6virus, Pamx74virus, Patiencevirus, Pbi1virus, Pepy6virus, Pfr1virus, Phic31virus, Phicbkvirus, Phietavirus, Phife1virus, Phij11virus, Pis4avirus, Psavirus, Psimunavirus, Rdj1virus, Rer2virus, Sap6virus, Send513virus, Septima3virus, Seuratvirus, Sextaecvirus, Sfi1 virus, Sfi21dt1virus, Sitaravirus, Sk1virus, Slashvirus, Smoothievirus, Soupsvirus, Spbetavirus, Ssp2virus, T5virus, Tankvirus, Tin2virus, Titanvirus, Tm4virus, Tp21virus, Tp84virus, Triavirus, Trigintaduovirus, Vegasvirus, Vendettavirus, Wbetavirus, Wildcatvirus, Wizardvirus, Woesvirus, Xp10virus, Ydn12virus and Yuavirus)

Bacteriophages may be selected from the family Ackermannviridae (such as, without limitation, genus Ag3virus, Limestonevirus, Cba120virus and Vi1virus)

Optionally, the bacteriophage is not part of the order Caudovirales but from families with unassigned order such as, without limitation, family Tectiviridae (such as genus Alphatectivirus, Betatectivirus), family Corticoviridae (such as genus Corticovirus), family Inoviridae (such as genus Fibrovirus, Habenivirus, Inovirus, Lineavirus, Plectrovirus, Saetivirus, Vespertiliovirus), family Cystoviridae (such as genus Cystovirus), family Leviviridae (such as genus Allolevivirus, Levivirus), family Microviridae (such as genus Alpha3microvirus, G4microvirus, Phix174microvirus, Bdellomicrovirus, Chlamydiamicrovirus, Spiromicrovirus) and family Plasmaviridae (such as genus Plasmavirus).

Optionally, the bacteriophage is targeting Archea not part of the Order Caudovirales but from families with Unassigned order such as, without limitation, Ampullaviridae, FuselloViridae, Globuloviridae, Guttaviridae, Lipothrixviridae, Pleolipoviridae, Rudiviridae, Salterprovirus and Bicaudaviridae.

A non-exhaustive listing of bacterial genera and their known host-specific bacteria viruses is presented in the following paragraphs. The chimeric RBPs and the bacterial delivery vehicles disclosed herein may be engineered, as non-limiting examples, from the following phages. Synonyms and spelling variants are indicated in parentheses. Homonyms are repeated as often as they occur (e.g., D, D, d). Unnamed phages are indicated by "NN" beside their genus and their numbers are given in parentheses.

Bacteria of the genus *Actinomyces* can be infected by the following phages: Av-I, Av-2, Av-3, BF307, CT1, CT2, CT3, CT4, CT6, CT7, CT8 and 1281.

Bacteria of the genus *Aeromonas* can be infected by the following phages: AA-I, Aeh2, N, PM1, TP446, 3, 4, 11, 13, 29, 31, 32, 37, 43, 43-10T, 51, 54, 55R.1, 56, 56RR2, 57, 58, 59.1, 60, 63, Aehl, F, PM2, 1, 25, 31, 40RR2.8t, (syn=44R), (syn=44RR2.8t), 65, PM3, PM4, PM5 and PM6.

Bacteria of the genus *Bacillus* can be infected by the following phages: A, aizl, A1-K-I, B, BCJA1, BC1, BC2, BLL1, BL1, BP142, BSL1, BSL2, BS1, BS3, BS8, BS15, BS18, BS22, BS26, BS28, BS31, BS104, BS105, BS106, BTB, B1715V1, C, CK-I, Coll, Corl, CP-53, CS-I, CSi, D, D, D, D5, ent1, FP8, FP9, FSi, FS2, FS3, FS5, FS8, FS9, G, GH8, GT8, GV-I, GV-2, GT-4, g3, g12, g13, g14, g16, g17, g21, g23, g24, g29, H2, kenl, KK-88, Kuml, Kyul, J7W-1, LP52, (syn=LP-52), L7, Mexl, MJ-I, mor2, MP-7, MP1O, MP12, MP14, MP15, Neol, No. 2, N5, N6P, PBC1, PBLA, PBP1, P2, S-a, SF2, SF6, Shal, Sill, SP02, (syn=(DSPP1), SPβ, STI, STi, SU-Il, t, TbI, Tb2, Tb5, TbIO, Tb26, Tb51, Tb53, Tb55, Tb77, Tb97, Tb99, Tb560, Tb595, Td8, Td6, Tdl5, TgI, Tg4, Tg6, Tg7, Tg9, TgIO, TgIl, Tg13, Tg15, Tg21, Tin1, Tin7, Tin8, Tin13, Tm3, Tocl, Togl, toll, TP-I, TP-10vir, TP-15c, TP-16c, TP-17c, TP-19, TP35, TP51, TP-84, Tt4, Tt6, type A, type B, type C, type D, type E, Tφ3, VA-9, W, wx23, wx26, Yun1, α, γ, p11, φmed-2, φT, φμ-4, φ3T, φ75, φ1O5, (syn=φ105), IA, IB, 1-97A, 1-97B, 2, 2, 3, 3, 3, 5, 12, 14, 20, 30, 35, 36, 37, 38, 41C, 51, 63, 64, 138D, I, II, IV, NN-*Bacillus* (13), alel, AR1, AR2, AR3, AR7, AR9, Bace-11, (syn=11), Bastille, BL1, BL2, BL3, BL4, BL5, BL6, BL8, BL9, BP124, BS28, BS80, Ch, CP-51, CP-54, D-5, darl, denl, DP-7, ent1, FoSi, FoS2, FS4, FS6, FS7, G, gall, gamma, GEl, GF-2, GSi, GT-I, GT-2, GT-3, GT-4, GT-5, GT-6, GT-7, GV-6, g15, 19, 110, ISi, K, MP9, MP13, MP21, MP23, MP24, MP28, MP29, MP30, MP32, MP34, MP36, MP37, MP39, MP40, MP41, MP43, MP44, MP45, MP47, MP50, NLP-I, No. 1, N17, N19, PBS1, PK1, PMB1, PMB12, PMJ1, S, SPO1, SP3, SP5, SP6, SP7, SP8, SP9, SP1O, SP-15, SP50, (syn=SP-50), SP82, SST, subl, SW, Tg8, Tg12, Tg13, Tg14, thul, thuA, thuS, Tin4, Tin23, TP-13, TP33, TP50, TSP-I, type V, type VI, V, Vx, β22, φe, φNR2, φ25, φ63, 1, 1, 2, 2C, 3NT, 4, 5, 6, 7, 8, 9, 10, 12, 12, 17, 18, 19, 21, 138, III, 4 (B. megateriwn), 4 (*B. sphaericus*), AR13, BPP-IO, BS32, BS107, B1, B2, GA-I, GP-IO, GV-3, GV-5, g8, MP20, MP27, MP49, Nf, PP5, PP6, SF5, Tg18, TP-I, Versailles, φ15, φ29, 1-97, 837/IV, mi-*Bacillus* (1), BatlO, BSL1O, BSLI1, BS6, BSI1, BS16, BS23, BS1O1, BS102, g18, morl, PBL1, SN45, thu2, thu3, TmI, Tm2, TP-20, TP21, TP52, type F, type G, type IV, HN-BacMus (3), BLE, (syn=θc), BS2, BS4, BS5, BS7, B1O, B12, BS20, BS21, F, MJ-4, PBA12, AP50, AP50-04, AP50-11, AP50-23, AP50-26, AP50-27 and Bam35. The following *Bacillus*-specific phages are defective: DLP10716, DLP- 11946, DPB5, DPB12, DPB21, DPB22, DPB23, GA-2, M, No. IM, PBLB, PBSH, PBSV, PBSW, PBSX, PBSY, PBSZ, phi, SPa, type 1 and μ.

Bacteria of the genus *Bacteroides* can be infected by the following phages: ad 12, Baf-44, Baf-48B, Baf-64, Bf-I, Bf-52, B40-8, F1, β1, φA1, φBrO1, φBrO2, 11, 67.1, 67.3, 68.1, mt-*Bacteroides* (3), Bf42, Bf71, HN-Bdellovibrio (1) and BF-41.

Bacteria of the genus *Bordetella* can be infected by the following phages: 134 and NN-*Bordetella* (3).

Bacteria of the genus *Borrellia* can be infected by the following phages: NN-*Borrelia* (1) and NN-*Borrelia* (2).

Bacteria of the genus *Brucella* can be infected by the following phages: A422, Bk, (syn=Berkeley), BM29, FOi, (syn=FO1), (syn=FQ1), D, FP2, (syn=FP2), (syn=FD2), Fz, (syn=Fz75/13), (syn=Firenze 75/13), (syn=Fi), Fi, (syn=F1), Fim, (syn=FIm), (syn=Fim), FiU, (syn=F1U), (syn=FiU), F2, (syn=F2), F3, (syn=F3), F4, (syn=F4), F5, (syn=F5), F6, F7, (syn=F7), F25, (syn=F25), (syn=£25), F25U, (syn=F25u), (syn=F25U), (syn=F25V), F44, (syn=F44), F45, (syn=F45), F48, (syn=F48), I, Im, M, MC/75, M51, (syn=M85), P, (syn=D), S708, R, Tb, (syn=TB), (syn=Tbilisi), W, (syn=Wb), (syn=Weybridge), X, 3, 6, 7, 10/1, (syn=F8), (syn=F8), (syn=F8), 12m, 24/11, (syn=24), (syn=F9), (syn=F9), 45/111, (syn=45), 75, 84, 212/XV, (syn=212), (syn=FiO), (syn=F1O), 371/XXIX, (syn=371), (syn=Fn), (syn=F11) and 513.

Bacteria of the genus *Burkholderia* can be infected by the following phages: CP75, NN-*Burkholderia* (1) and 42.

Bacteria of the genus *Campylobacter* can be infected by the following phages: C type, NTCC12669, NTCC12670, NTCC12671, NTCC12672, NTCC12673, NTCC12674, NTCC12675, NTCC12676, NTCC12677, NTCC12678, NTCC12679, NTCC12680, NTCC12681, NTCC12682, NTCC12683, NTCC12684, 32f, 11c, 191, NN-*Campylobacter* (2), Vfi-6, (syn=V19), VfV-3, V2, V3, V8, V16, (syn=Vfi-1), V19, V20 (V45), V45, (syn=V-45) and NN-*Campylobacter* (1).

Bacteria of the genus *Chlamydia* can be infected by the following phage: Chp1.

Bacteria of the genus *Clostridium* can be infected by the following phages: CAK1, CA5, Ca7, CEβ, (syn=1C), CEγ, Cld1, c-n71, c-203 Tox–, DEβ, (syn=ID), (syn=IDtOX+), HM3, KMI, KT, Ms, NA1, (syn=Naltox+), PA135Oe, Pfó, PL73, PL78, PL81, P1, P50, P5771, P19402, 1CtOX+, 2CtOX\2D3 (syn=2DtOX+), 3C, (syn=3Ctox+), 4C, (syn=4CtOX+), 56, III-1, NN-*Clostridium* (61), NBltOX+, α1, CAl, HMT, HM2, PF15 P-23, P-46, Q-05, Q-oe, Q-16, Q-21, Q-26, Q-40, Q-46, S111, SA02, WA01, WA03, Wm, W523, 80, C, CA2, CA3, CPT1, CPT4, cl, c4, c5, HM7, H11/A1, H18/Ax, FWS23, Hi58ZA1, K2ZA1, K21ZS23, ML, NA2tOX; Pf2, Pf3, Pf4, S9ZS3, S41ZA1, S44ZS23, α2, 41, 112ZS23, 214/S23, 233/Ai, 234/S23, 235/S23, II-1, II-2, II-3, NN-*Clostridium* (12), CA1, F1, K, S2, 1, 5 and NN-*Clostridium* (8).

Bacteria of the genus *Corynebacterium* can be infected by the following phages: CGK1 (defective), A, A2, A3, AlOl, A128, A133, A137, A139, A155, A182, B, BF, B17, B18, B51, B271, B275, B276, B277, B279, B282, C, capi, CC1, CG1, CG2, CG33, CL31, Cog, (syn=CG5), D, E, F, H, H-I, hqi, hq2, 11ZH33, Ii/31, J, K, K, (syn=Ktox"), L, L, (syn=Ltox+), M, MC-I, MC-2, MC-3, MC-4, MLMa, N, O, ovi, ov2, ov3, P, P, R, RP6, RS29, S, T, U, UB 1, ub2, UH1, UH3, uh3, uh5, uh6, β, (syn=βtox+), βhv64, βvir, γ, (syn=γtoχ–), γ19, δ, (syn=δ'ox+), p, (syn=ptoχ–), Φ9, φ984, ω, IA, 1/1180, 2, 2/1180, 5/1180, 5ad/9717, 7/4465, 8/4465, 8ad/10269, 10/9253, 13Z9253, 15/3148, 21/9253, 28, 29, 55, 2747, 2893, 4498 and 5848.

Bacteria of the genus *Enterococcus* are infected by the following phage: DF78, F1, F2, 1, 2, 4, 14, 41, 867, D1, SB24, 2BV, 182, 225, C2, C2F, E3, E62, DS96, H24, M35, P3, P9, SB1O1, S2, 2BII, 5, 182a, 705, 873, 881, 940, 1051, 1057, 21096C, NN-*Enterococcus* (1), PE1, F1, F3, F4, VD13, 1, 200, 235 and 341.

Bacteria of the genus *Erysipelothrix* can be infected by the following phage: NN-Eiysipelothrix (1).

Bacteria of the genus *Escherichia* can be infected by the following phages: BW73, B278, D6, D108, E, E1, E24, E41, FI-2, FI-4, FI-5, HI8A, Ff18B, i, MM, Mu, (syn=mu), (syn=MuI), (syn=Mu-I), (syn=MU-I), (syn=MuI), (syn=μ), 025, PhI-5, Pk, PSP3, P1, P1D, P2, P4 (defective), S1, Wφ, φK13, φR73 (defective), φ1, φ2, φ7, φ92, ψ (defective), 7 A, 8φ, 9φ, 15 (defective), 18, 28-1, 186, 299, HH-*Escherichia* (2), AB48, CM, C4, C16, DD-VI, (syn=Dd-Vi), (syn=DDVI), (syn=DDVi), E4, E7, E28, FI1, FI3, H, H1, H3, H8, K3, M, N, ND-2, ND-3, ND4, ND-5, ND6, ND-7, Ox-I (syn=OX1), (syn=HF), Ox-2 (syn=0x2), (syn=0X2), Ox-3, Ox-4, Ox-5, (syn=0X5), Ox-6, (syn=66F), (syn=φ66t), (syn=φ66t–)5 0111, PhI-I, RB42, RB43, RB49, RB69, S, Sal-I, Sal-2, Sal-3, Sal-4, Sal-5, Sal-6, TC23, TC45, TuII*-6, (syn=TuII*), TuIP-24, TuII*46, TuIP-60, T2, (syn=ganuTia), (syn=γ), (syn=PC), (syn=P.C.), (syn=T-2), (syn=T2), (syn=P4), T4, (syn=T-4), (syn=T4), T6, T35, α1, 1, IA, 3, (syn=Ac3), 3A, 3T+, (syn=3), (syn=M1), 5φ, (syn=φ5), 9266Q, CFO103, HK620, J, K, K1F, m59, no. A, no. E, no. 3, no. 9, N4, sd, (syn=Sd), (syn=SD), (syn=Sa)3 (syn=sd), (syn=SD), (syn=CD), T3, (syn=T-3), (syn=T3), T7, (syn=T-7), (syn=T7), WPK, W31, ΔH, φC3888, φK3, φK7, φK12, φV-1, Φ04-CF, Φ05, Φ06, Φ07, φ1, φ1.2, φ20, φ95, φ263, φ1O92, φ1, φ11, (syn=φW), Ω8, 1, 3, 7, 8, 26, 27, 28-2, 29, 30, 31, 32, 38, 39, 42, 933W, NN-*Escherichia* (1), Esc-7-11, AC30, CVX-5, C1, DDUP, EC1, EC2, E21, E29, F1, F26S, F27S, Hi, HK022, HK97, (syn=O(HK97), HK139, HK253, HK256, K7, ND-I, no. D, PA-2, q, S2, T1, (syn=α), (syn=P28), (syn=T-I), (syn=Tx), T3C, T5, (syn=T-5), (syn=T5), UC-I, w, β4, γ2, λ (syn=lambda), (syn=Φλ), ΦD326, φγ, Φ06, Φ7, Φ10, φ80, χ, (syn=χi), (syn=φ χ), (syn=φχi), 2, 4, 4A, 6, 8A, 102, 150, 168, 174, 3000, AC6, AC7, AC28, AC43, AC50, AC57, AC81, AC95, HK243, K1O, ZG/3A, 5, 5A, 21EL, H19-J and 933H.

Bacteria of the genus *Fusobacterium* are infected by the following phage: NN-*Fusobacterium* (2), fv83-554/3, fv88-531/2, 227, fv2377, fv2527 and fv8501.

Bacteria of the genus *Haemophilus* are infected by the following phage: HP1, S2 and N3.

Bacteria of the genus *Helicobacter* are infected by the following phage: HP1 and ^^-*Helicobacter* (1).

Bacteria of the genus *Klebsiella* are infected by the following phage: AIO-2, KI4B, K16B, K19, (syn=K19), K114, K115, K121, K128, K129, KI32, K133, K135, K1106B, K1171B, K1181B, K1832B, AIO-I, AO-I, AO-2, AO-3, FC3-10, K, K11, (syn=KII), K12, (syn=K12), K13, (syn=K13), (syn=K1 70/11), K14, (syn=K14), K15, (syn=K15), K16, (syn=K16), K17, (syn=K17), K18, (syn=K18), K119, (syn=K19), K127, (syn=K127), K131, (syn=K131), K135, K1171B, II, VI, IX, CI-I, K14B, K18, K111, K112, K113, K116, K117, K118, K120, K122, K123, K124, K126, K130, K134, K106B, KIi65B, K1328B, KLXI, K328, P5046, 11, 380, III, IV, VII, VIII, FC3-11, K12B, (syn=K12B), K125, (syn=K125), K142B, (syn=K142), (syn=K142B), K1181B, (syn=KII 81), (syn=K1181B), K1765/!, (syn=K1765/1), K1842B, (syn=K1832B), K1937B, (syn=K1937B), L1, φ28, 7, 231, 483, 490, 632 and 864/100.

Bacteria of the genus *Lepitospira* are infected by the following phage: LE1, LE3, LE4 and ~NN-*Leptospira* (1).

Bacteria of the genus *Listeria* are infected by the following phage: A511, 01761, 4211, 4286, (syn=BO54), A005, A006, A020, A500, A502, A511, A118, A620, A640, B012, B021, B024, B025, B035, B051, B053, B054, B055, B056, B1Ol1, BI 10, B545, B604, B653, C707, D441, HSO47, H1OG, H8/73, H19, H21, H43, H46, H107, H108, HI 10, H163/84, H312, H340, H387, H391/73, H684/74, H924A, PSA, U153, φMLUP5, (syn=P35), 00241, 00611, 02971A, 02971C, 5/476, 5/911, 5/939, 5/11302, 5/11605, 5/11704, 184, 575, 633, 699/694, 744, 900, 1090, 1317, 1444, 1652, 1806, 1807, 1921/959, 1921/11367, 1921/11500, 1921/11566, 1921/12460, 1921/12582, 1967, 2389, 2425, 2671, 2685, 3274, 3550, 3551, 3552, 4276, 4277, 4292, 4477, 5337, 5348/11363, 5348/11646, 5348/12430, 5348/12434, 10072, 11355C, 11711A, 12029, 12981, 13441, 90666, 90816, 93253, 907515, 910716 and NN-Lisferia (15).

Bacteria of the genus *Morganella* are infected by the following phage: 47.

Bacteria of the genus *Mycobacterium* are infected by the following phage: 13, AGI, ALi, ATCC 11759, A2, B.C3, BG2, BKl, BK5, butyricum, B-I, B5, B7, B30, B35, Clark, C1, C2, DNAIII, DSP1, D4, D29, GS4E, (syn=GS4E), GS7, (syn=GS-7), (syn=GS7), IPa, lacticola, Legendre, Leo, L5, (syn=PL-5), MC-I, MC-3, MC-4, minetti, MTPHI1, Mx4, MyF3P/59a, phlei, (syn=phlei 1), phlei 4, Polonus II, rabinovitschi, smegmatis, TM4, TM9, TM1O, TM20, Y7, Y10, φ630, IB, IF, IH, 1/1, 67, 106, 1430, B1, (syn=Bol), B24, D, D29, F—K, F—S, HP, Polonus I, Roy, R1, (syn=R1-Myb), (syn=Ri), 11, 31, 40, 50, 103a, 103b, 128, 3111-D, 3215-D and NN-*Mycobacterium* (1).

Bacteria of the genus *Neisseria* are infected by the following phage: Group I, group II and NP1.

Bacteria of the genus *Nocardia* are infected by the following phage: MNP8, NJ-L, NS-8, N5 and TtiN-*Nocardia*.

Bacteria of the genus *Proteus* are infected by the following phage: Pm5, 13vir, 2/44, 4/545, 6/1004, 13/807, 20/826, 57, 67b, 78, 107/69, 121, 9/0, 22/608, 30/680, PmI, Pm3, Pm4, Pm6, Pm7, Pm9, PmIO, PmI1, Pv2, π1, φm, 7/549, 9B/2, 10A/31, 12/55, 14, 15, 16/789, 17/971, 19A/653, 23/532, 25/909, 26/219, 27/953, 32A/909, 33/971, 34/13, 65, 5006M, 7480b, VI, 13/3a, Clichy 12, π2600, φχ7, 1/1004, 5/742, 9, 12, 14, 22, 24/860, 2600/D52, Pm8 and 24/2514.

Bacteria of the genus *Providencia* are infected by the following phage: PL25, PL26, PL37, 9211/9295, 9213/921 Ib, 9248, 7/R49, 7476/322, 7478/325, 7479, 7480, 9000/9402 and 9213/921 Ia.

Bacteria of the genus *Pseudomonas* are infected by the following phage: Pfl, (syn=Pf-I), Pf2, Pf3, PP7, PRR1, 7s, im-*Pseudomonas* (1), AI-I, AI-2, B 17, B89, CB3, Col 2, Col 11, Col 18, Col 21, C154, C163, C167, C2121, E79, F8, ga, gb, H22, K1, M4, N2, Nu, PB-I, (syn=PBl), pfl6, PMN17, PP1, PP8, Psal, PsP1, PsP2, PsP3, PsP4, PsP5, PS3, PS17, PTB80, PX4, PX7, PYO1, PYO2, PYO5, PYO6, PYO9, PYO1O, PYO13, PYO14, PYO16, PYO18, PYO19, PYO20, PYO29, PYO32, PYO33, PYO35, PYO36, PYO37, PYO38, PYO39, PYO41, PYO42, PYO45, PYO47, PYO48, PYO64, PYO69, PYO103, P1K, SLP1, SL2, S2, UNL-I, wy, Yai, Ya4, Yan, φBE, φCTX, φC17, φKZ, (syn=ΦKZ), φ-LT, Φmu78, φNZ, φPLS-1, φST-1, φW-14, φ-2, 1/72, 2/79, 3, 3/DO, 4/237, 5/406, 6C, 6/6660, 7, 7v, 7/184, 8/280, 9/95, 10/502, 11/DE, 12/100, 12S, 16, 21, 24, 25F, 27, 31, 44, 68, 71, 95, 109, 188, 337, 352, 1214, HN-*Pseudomonas* (23), A856, B26, CI-I, CI-2, C5, D, gh-1, F1 16, HF, H90, K5, K6, K104, K109, K166, K267, N4, N5, O6N-25P, PE69, Pf, PPN25, PPN35, PPN89, PPN91, PP2, PP3, PP4, PP6, PP7, PP8, PP56, PP87, PP114, PP206, PP207, PP306, PP651, Psp231a, Pssy401, Pssy9220, psi, PTB2, PTB20, PTB42, PX1, PX3, PX1O, PX12, PX14, PYO70, PYO71, R, SH6, SH133, tf, Ya5, Ya7, φBS, ΦKf77, φ-MC, ΦmnF82, φPLS27, φPLS743, φS-1, 1, 2, 2, 3, 4, 5, 6, 7, 7, 8, 9, 10, 11, 12, 12B, 13, 14, 15, 14, 15, 16, 17, 18, 19, 20, 20, 21, 21, 22, 23, 23, 24, 25, 31, 53, 73, 119x, 145, 147, 170, 267, 284, 308, 525, NN-*Pseudomonas* (5), af, A7, B3, B33, B39, BI-I, C22, D3, D37, D40, D62, D3112, F7, F1O, g, gξ, ge, g Hw12, Jb 19, KF1, L°, OXN-32P, O6N-52P, PCH-I, PC13-1, PC35-1, PH2, PH51, PH93, PH132, PMW, PM13, PM57, PM61, PM62, PM63, PM69, PM105, PM1 13, PM681, PM682, PO4, PP1, PP4, PP5, PP64, PP65, PP66, PP71, PP86, PP88, PP92, PP401, PP711, PP891, Pssy41, Pssy42, Pssy403, Pssy404, Pssy420, Pssy923, PS4, PS-IO, Pz, SD1, SL1, SL3, SL5, SM, φC5, φC11, φC11-1, φC13, φC15, φMO, φX, φO4, φ11, φ240, 2, 2F, 5, 7m, 11, 13, 13/441, 14, 20, 24, 40, 45, 49, 61, 73, 148, 160, 198, 218, 222, 236, 242, 246, 249, 258, 269, 295, 297, 309, 318, 342, 350, 351, 357-1, 400-1, HN-*Pseudomonas* (6), G1O1, M6, M6a, L1, PB2, Pssy15, Pssy4210, Pssy4220, PYO12, PYO34, PYO49, PYO50, PYO51, PYO52, PYO53, PYO57, PYO59, PYO200, PX2, PX5, SL4, pO3, 0pO6 and 1214.

Bacteria of the genus *Rickettsia* are infected by the following phage: NN-*Rickettsia*.

Bacteria of the genus *Salmonella* are infected by the following phage: b, Beccles, CT, d, Dundee, f, FeIs 2, GI, GUI, GVI, GVIII, k, K, i, j, L, 01, (syn=0-1), (syn=O1), (syn=O-I), (syn=7), 02, 03, P3, P9a, P1O, Sab3, Sab5, SanlS, San17, SI, Taunton, ViI, (syn=Vil), 9, imSalmonella (1), N—I, N-5, N-IO, N-17, N-22, 11, 12, 16-19, 20.2, 36, 449C/C178, 966A/C259, a, B.A.O.R., e, G4, GUI, L, LP7, M, MG40, N-18, PSA68, P4, P9c, P22, (syn=P22), (syn=PLT22), (syn=PLT22), P22al, P22-4, P22-7, P22-11, SNT-I, SNT-2, SP6, Villi, ViIV, ViV, ViVI, ViVII, Worksop, Sj5, ε34, 1,37, 1(40), (syn=φ1[40]), 1,422, 2, 2.5, 3b, 4, 5, 6, 14(18), 8, 14(6,7), 10, 27, 28B, 30, 31, 32, 33, 34, 36, 37, 39, 1412, SNT-3, 7-11, 40.3, c, C236, C557, C625, C966N, g, GV, G5, G1 73, h, IRA, Jersey, MB78, P22-1, P22-3, P22-12, Sab1, Sab2, Sab3, Sab4, San1, San2, San3, San4, San6, San7, San8, San9, San13, San14, San16, San18, San19, San20, San21, San22, San23, San24, San25, San26, SasL1, SasL2, SasL3, SasL4, SasL5, S1BL, SII, ViII, φ1, 1, 2, 3a, 3al, 1010, Ym-*Salmonella* (1), N-4, SasL6 and 27.

Bacteria of the genus *Serratia* are infected by the following phage: A2P, PS20, SMB3, SMP, SMP5, SM2, V40, V56, ic, ΦCP-3, ΦCP-6, 3M, 10/1a, 20A, 34CC, 34H, 38T, 345G, 345P, 501B, SMB2, SMP2, BC, BT, CW2, CW3, CW4, CW5, Lt232, L2232, L34, L.228, SLP, SMPA, V.43, σ, φCW1, ΦCP6-1, ΦCP6-2, ΦCP6-5, 3T, 5, 8, 9F, 10/1, 20E, 32/6, 34B, 34CT, 34P, 37, 41, 56, 56D, 56P, 60P, 61/6, 74/6, 76/4, 101/8900, 226, 227, 228, 229F, 286, 289, 290F, 512, 764a, 2847/10, 2847/10a, L.359 and SMB1.

Bacteria of the genus *Shigella* are infected by the following phage: Fsa, (syn=a), FSD2d, (syn=D2d), (syn=W2d), FSD2E, (syn=W2e), fv, F6, f7.8, H-Sh, PE5, P90, SfII, Sh, SHm, SHrv, (syn=HIV), SHvi, (syn=HVI), SHVvm, (syn=HVIII), SKγ66, (syn=gamma 66), (syn=γββ), (syn=γ66b), SKm, (syn=SIIIb)5 (syn=UI), SKw, (syn=Siva), (syn=IV), SIC™, (syn=SIVA.), (syn=IVA), SKvi, (syn=KVI), (syn=Svi), (syn=VI), SKvm, (syn=Svm), (syn=VIII), SKVIIA, (syn=SvmA), (syn=VIIIA), STvi, STK, STx1, STxn, S66, W2, (syn=D2c), (syn=D20), φ1, φIVb 3-SO-R, 8368-SO-R, F7, (syn=FS7), (syn=K29), FlO, (syn=FS1O), (syn=K31), I1, (syn=alfa), (syn=FSa), (syn=K18), (syn=α), 12, (syn=α), (syn=K19), SG33, (syn=G35), (syn=SO-35/G), SG35, (syn=SO-55/G), SG3201, (syn=SO-3201/G), SHn, (syn=HII), SHv, (syn=SHV), SHx, SHX, SKn, (syn=K2), (syn=KII), (syn=Sn), (syn=SsII), (syn=II), SKrv, (syn=Sm), (syn=SsIV), (syn=IV), SK1Va, (syn=Swab), (syn=SsIVa), (syn=IVa), SKV, (syn=K4), (syn=KV), (syn=SV), (syn=SsV), (syn=V), SKx, (syn=K9), (syn=KX), (syn=SX), (syn=SsX), (syn=X), STV, (syn=T35), (syn=35-50-R), STvm, (syn=T8345), (syn=8345-SO—S-R), W1, (syn=D8), (syn=FSD8), W2a, (syn=D2A), (syn=FS2a), DD-2, Sf6, FSi, (syn=F1), SF6, (syn=F6), SG42, (syn=SO-42/G), SG3203, (syn=SO-3203/G), SKF12, (syn=SsF12), (syn=F12), (syn=F12), STn, (syn=1881-SO-R), γ66, (syn=gamma 66a), (syn=Ssy66), φ2, BI1, DDVII, (syn=DD7), FSD2b, (syn=W2B), FS2, (syn=F2), (syn=F2), FS4, (syn=F4), (syn=F4), FS5, (syn=F5), (syn=F5), FS9, (syn=F9), (syn=F9), FI1, P2-SO-S, SG36, (syn=SO-36/G), (syn=G36), SG3204, (syn=SO-3204/G), SG3244, (syn=SO-3244/G), SHi, (syn=HI), SHvπ, (syn=HVII), SHK, (syn=HIX), SHx1, SHxπ, (syn=HXn), SKI, KI, (syn=S1), (syn=SsI), SKVII, (syn=KVII), (syn=Svπ), (syn=SsVII), SKIX, (syn=KIX), (syn=S1x), (syn=SsIX), SKXII, (syn=KXII), (syn=Sxn), (syn=SsXII), STi, STffl, STrv, STVi, STvπ, S70, S206, U2-SO-S, 3210-SO-S, 3859-SO-S, 4020-SO-S, φ3, φ5, φ7, φ8, φ9, φlO, φ11, φ13, φ14, φ18, SHm, (syn=Hπi), SHχi, (syn=HXt) and SKxI, (syn=KXI), (syn=Sχi), (syn=SsXI), (syn=XI).

Bacteria of the genus *Staphylococcus* are infected by the following phage: A, EW, K, Ph5, Ph9, PhIO, Ph13, P1, P2, P3, P4, P8, P9, P1O, RG, SB-i, (syn=Sb-I), S3K, Twort, ΦSK311, φ812, 06, 40, 58, 119, 130, 131, 200, 1623, STC1, (syn=stcl), STC2, (syn=stc2), 44AHJD, 68, AC1, AC2, A6"C", A9"C", b581, CA-I, CA-2, CA-3, CA-4, CA-5, DI 1, L39x35, L54a, M42, N1, N2, N3, N4, N5, N7, N8, N1O, Ni 1, N12, N13, N14, N16, Ph6, Phl2, Phl4, UC-18, U4, U15, S1, S2, S3, S4, S5, X2, Z1, φB5-2, φD, ω, 11, (syn=φ11), (syn=P11-M15), 15, 28, 28A, 29, 31, 31B, 37, 42D, (syn=P42D), 44A, 48, 51, 52, 52A, (syn=P52A), 52B, 53, 55, 69, 71, (syn=P71), 71A, 72, 75, 76, 77, 79, 80, 80a, 82, 82A, 83 A, 84, 85, 86, 88, 88A, 89, 90, 92, 95, 96, 102, 107, 108, 111, 129-26, 130, 130A, 155, 157, 157A, 165, 187, 275, 275A, 275B, 356, 456, 459, 471, 471A, 489, 581, 676, 898, 1139, 1154A, 1259, 1314, 1380, 1405, 1563, 2148, 2638A, 2638B, 2638C, 2731, 2792A, 2792B, 2818, 2835, 2848A, 3619, 5841, 12100, AC3, A8, AlO, A13, b594n, D, HK2, N9, N15, P52, P87, S1, S6, Z4, φRE, 3A, 3B, 3C, 6, 7, 16, 21, 42B, 42C, 42E, 44, 47, 47A5 47C, 51, 54, 54x1, 70, 73, 75, 78, 81, 82, 88, 93, 94, 101, 105, 110, 115, 129/16, 174, 594n, 1363/14, 2460 and mS-*Staphylococcus* (1).

Bacteria of the genus *Streptococcus* are infected by the following phage: EJ-I, NN-Streptococais (1), a, C1, FLOThs, H39, Cp-I, Cp-5, Cp-7, Cp-9, Cp-IO, AT298, AS, alO/J1, alO/J2, alO/J5, alO/J9, A25, BTI 1, b6, CA1, c20-1, c20-2, DP-I, Dp-4, DT1, ET42, elO, FA101, FETHs, Fx, FKKIOI, FKLIO, FKP74, FKH, FLOThs, FyIOl, fl, F10, F20140/76, g, GT-234, HB3, (syn=HB-3), HB-623, HB-746, M102, O1205, φO1205, PST, PO, P1, P2, P3, P5, P6, P8, P9, P9, P12, P13, P14, P49, P50, P51, P52, P53, P54, P55, P56, P57, P58, P59, P64, P67, P69, P71, P73, P75, P76, P77, P82, P83, P88, sc, sch, sf, Sfl1, (syn=SFil 1), (syn=φSFi11), (syn=ΦSfi11), (syn=φSfi11), sfi19, (syn=SFi19), (syn=φSFi19), (syn=φSfi19), Sfi21, (syn=SFi21), (syn=φSFi21), (syn=φSfi21), ST0, STX, st2, ST2, ST4, S3, (syn=φS3), s265, (17, φ42, 157, φ80, φ81, φ82, φ83, φ84, φ85, φ86, φ87, φ88, φ89, φ90, φ91, φ92, φ93, φ94, φ95, φ96, φ97, φ98, φ99, φ1OO, φ1O1, φ1O2, φ227, Φ7201, ω1, ω2, ω3, ω4, ω5, ω6, ω8, ωlO, 1, 6, 9, 1OF, 12/12, 14, 17SR, 19S, 24, 50/33, 50/34, 55/14, 55/15, 70/35, 70/36, 71/ST15, 71/45, 71/46, 74F, 79/37, 79/38, 80/J4, 80/J9, 80/ST16, 80/15, 80/47, 80/48, 101, 103/39, 103/40, 121/41, 121/42, 123/43, 123/44, 124/44, 337/ST17 and mStreptococcus (34).

Bacteria of the genus *Treponema* are infected by the following phage: NN-*Treponema* (1).

Bacteria of the genus *Vibrio* are infected by the following phage: CTXΦ, fs, (syn=si), fs2, Ivpfs, Vfl2, Vf33, VPIΦ, VSK, v6, 493, CP-T1, ET25, kappa, K139, Labol,)XN-69P, OXN-86, O6N-21P, PB-I, P147, rp-1, SE3, VA-I, (syn=VcA-I), VcA-2, VPI, VP2, VP4, VP7, VP8, VP9, VP1O, VP17, VP18, VP19, X29, (syn=29 d'Herelle), t, ΦHAWI-1, ΦHAWI-2, ΦHAWI-3, ΦHAWI-4, ΦHAWI-5, ΦHAWI-6, ΦHAWI-7, XHAWI-8, ΦHAWI-9, ΦHAWI-10, ΦHC1-1, ΦHC1-2, ΦHC1-3, ΦHC1-4, ΦHC2-1, >HC2-2, ΦHC2-3, ΦHC2-4, ΦHC3-1, ΦHC3-2, ΦHC3-3, ΦHD1S-1, HD1S-2, ΦHD2S-1, ΦHD2S-2, ΦHD2S-3, ΦHD2S-4, ΦHD2S-5, ΦHDO-1, ΦHDO-2, ΦHDO-3, ΦHDO-4, ΦHDO-5, ΦHDO-6, ΦKL-33, ΦKL-34, ΦKL-35, ΦKL-36, ΦKWH-2, ΦKWH-3, ΦKWH-4, ΦMARQ-1, ΦMARQ-2, ΦMARQ-3, ΦMOAT-1, ΦO139, ΦPEL1A-1, ΦPEL1A-2, ΦPEL8A-1, ΦPEL8A-2, ΦPEL8A-3, ΦPEL8C-1, ΦPEL8C-2, ΦPEL13A-1, ΦPEL13B-1, ΦPEL13B-2, ΦPEL13B-3, ΦPEL13B-4, ΦPEL13B-5, ΦPEL13B-6, ΦPEL13B-7, ΦPEL13B-8, ΦPEL13B-9, ΦPEL13B-10, φVP143, φVP253, Φ16, φ138, 1-II, 5, 13, 14, 16, 24, 32, 493, 6214, 7050, 7227, II, (syn=group II), (syn==φ2), V, VIII, ~m-*Vibrio* (13), KVP20, KVP40, nt-1, O6N-22P, P68, e1, e2, e3, e4, e5, FK, G, I, K, nt-6, N1, N2, N3, N4, N5, O6N-34P, OXN-72P, OXN-85P, OXN-100P, P, Ph-I, PL163/10, Q, S, T, φ92, 1-9, 37, 51, 57, 70A-8, 72A-4, 72A-10, 110A-4, 333, 4996, I (syn=group I), III (syn=group III), VI, (syn=A-Saratov), VII, IX, X, HN-*Vibrio* (6), pAl, 7, 7-8, 70A-2, 71A-6, 72A-5, 72A-8, 108A-10, 109A-6, 109A-8, 11OA-1, 110A-5, 110A-7, hv-1, OXN-52P, P13, P38, P53, P65, P108, Pi11, TP13 VP3, VP6, VP12, VP13, 70A-3, 70A-4, 70A-10, 72A-1, 108A-3, 109-B1, 110A-2, 149, (syn=φ149), IV, (syn=group IV), NN-*Vibrio* (22), VP5, VPI, VP15, VP16, α1, α2, α3a, α3b, 353B and HN-*Vibrio* (7).

Bacteria of the genus *Yersinia* are infected by the following phage: H, H-1, H-2, H-3, H-4, Lucas 110, Lucas 303, Lucas 404, YerA3, YerA7, YerA20, YerA41, 3/M64-76, 5/G394-76, 6/C753-76, 8/C239-76, 9/F18167, 1701, 1710, PST, 1/F2852-76, D'Herelle, EV, H, Kotljarova, PTB, R, Y, YerA41, φYerO3-12, 3, 4/C1324-76, 7/F783-76, 903, 1/M6176 and Yer2AT.

More preferably, the bacteriophage is selected in the group consisting of *Salmonella* virus SKML39, *Shigella* virus AG3, *Dickeya* virus Limestone, *Dickeya* virus RC2014, *Escherichia* virus CBA120, *Escherichia* virus PhaxI, *Salmonella* virus 38, *Salmonella* virus Det7, *Salmonella* virus GG32, *Salmonella* virus PM10, *Salmonella* virus SFP10, *Salmonella* virus SH19, *Salmonella* virus SJ3, *Escherichia* virus ECML4, *Salmonella* virus Marshall, *Salmonella* virus Maynard, *Salmonella* virus SJ2, *Salmonella* virus STML131, *Salmonella* virus Vil, *Erwinia* virus Ea2809, *Klebsiella* virus 0507KN21, *Serratia* virus IME250, *Serratia* virus MAM1, *Campylobacter* virus CP21, *Campylobacter* virus CP220, *Campylobacter* virus CPt10, *Campylobacter* virus IBB35, *Campylobacter* virus CP81, *Campylobacter* virus CP30A, *Campylobacter* virus CPX, *Campylobacter* virus NCTC 12673, *Erwinia* virus Ea214, *Erwinia* virus M7, *Escherichia* virus AYO145A, *Escherichia* virus EC6, *Escherichia* virus HY02, *Escherichia* virus JH2, *Escherichia* virus TP1, *Escherichia* virus VpaE1, *Escherichia* virus wV8, *Salmonella* virus FelixO1, *Salmonella* virus HB2014, *Salmonella* virus Mushroom, *Salmonella* virus UAB87, *Citrobacter* virus Moogle, *Citrobacter* virus Mordin, *Escherichia* virus SUSP1, *Escherichia* virus SUSP2, *Aeromonas* virus phiOl8P, *Haemophilus* virus HP1, *Haemophilus* virus HP2, *Pasteurella* virus F108, *Vibrio* virus K139, *Vibrio* virus Kappa, *Burkholderia* virus phi52237, *Burkholderia* virus phiE122, *Burkholderia* virus phiE202, *Escherichia* virus 186, *Escherichia* virus P4, *Escherichia* virus P2, *Escherichia* virus Wphi, *Mannheimia* virus PHL101, *Pseudomonas* virus phiCTX, *Ralstonia* virus RSA1, *Salmonella* virus Fels2, *Salmonella* virus PsP3, *Salmonella* virus SopEphi, *Yersinia* virus L413C, *Staphylococcus* virus G1, *Staphylococcus* virus G15, *Staphylococcus* virus JD7, *Staphylococcus* virus K, *Staphylococcus* virus MCE2014, *Staphylococcus* virus P108, *Staphylococcus* virus Rodi, *Staphylococcus* virus S253, *Staphylococcus* virus S25-4, *Staphylococcus* virus SA12, *Listeria* virus A511, *Listeria* virus P100, *Staphylococcus* virus Remus, *Staphylococcus* virus SA11, *Staphylococcus* virus Stau2, *Bacillus* virus Camphawk, *Bacillus* virus SPO1, *Bacillus* virus BCP78, *Bacillus* virus TsarBomba, *Staphylococcus* virus Twort, *Enterococcus* virus phiEC24C, *Lactobacillus* virus Lb338-1, *Lactobacillus* virus LP65, *Enterobacter* virus PG7, *Escherichia* virus CC31, *Klebsiella* virus JD18, *Klebsiella* virus PKO111, *Escherichia* virus Bp7, *Escherichia* virus IME08, *Escherichia* virus JS10, *Escherichia* virus JS98, *Escherichia* virus QLO1, *Escherichia* virus VR5, *Enterobacter* virus Eap3, *Klebsiella* virus KP15, *Klebsiella* virus KP27, *Klebsiella* virus Matisse, *Klebsiella* virus Miro, *Citrobacter* virus Merlin, *Citrobacter* virus Moon, *Escherichia* virus JSE, *Escherichia* virus phil, *Escherichia* virus RB49, *Escherichia* virus HX01, *Escherichia* virus JS09, *Escherichia* virus RB69, *Shigella* virus UTAM, *Salmonella* virus S16, *Salmonella* virus STML198, *Vibrio* virus KVP40, *Vibrio* virus nt1, *Vibrio* virus ValKK3, *Escherichia* virus VR7, *Escherichia* virus VR20, *Escherichia* virus VR25, *Escherichia* virus VR26, *Shigella* virus SP18, *Escherichia* virus AR1, *Escherichia* virus C40, *Escherichia* virus E112, *Escherichia* virus ECML134, *Escherichia* virus HY01, *Escherichia* virus Ime09, *Escherichia* virus RB3, *Escherichia* virus RB14, *Escherichia* virus T4, *Shigella* virus Pss1, *Shigella* virus Shfl2, *Yersinia* virus D1, *Yersinia* virus PST, *Acinetobacter* virus 133, *Aeromonas* virus 65, *Aeromonas* virus Aehl, *Escherichia* virus RB16, *Escherichia* virus RB32, *Escherichia* virus RB43, *Pseudomonas* virus 42, *Cronobacter* virus CR3, *Cronobacter* virus CR8, *Cronobacter* virus CR9, *Cronobacter* virus PBES02, *Pectobacterium* virus phiTE, *Cronobacter* virus GAP31, *Escherichia* virus 4MG, *Salmonella* virus SE1, *Salmonella* virus SSE121, *Escherichia* virus FFH2, *Escherichia* virus FV3, *Escherichia* virus JES2013, *Escherichia* virus V5, *Brevibacillus* virus Abouo, *Brevibacillus* virus Davies, *Bacillus* virus Agate, *Bacillus* virus Bobb, *Bacillus* virus Bp8pC, *Erwinia* virus Deimos, *Erwinia* virus Ea35-70, *Erwinia* virus RAY, *Erwinia* virus Simmy50, *Erwinia* virus SpecialG, *Acinetobacter* virus AB1, *Acinetobacter* virus AB2, *Acinetobacter* virus AbC62, *Acinetobacter* virus AP22, *Arthrobacter* virus ArV1, *Arthrobacter* virus Trina, *Bacillus* virus AvesoBmore, *Bacillus* virus B4, *Bacillus* virus Bigbertha, *Bacillus* virus Riley, *Bacillus* virus Spock, *Bacillus* virus Troll, *Bacillus* virus Bastille, *Bacillus* virus CAM003, *Bacillus* virus Bc431, *Bacillus* virus Bcp1, *Bacillus* virus BCP82, *Bacillus* virus BM15, *Bacillus* virus Deepblue, *Bacillus* virus JBP901, *Burkholderia* virus Bcep1, *Burkholderia* virus Bcep43, *Burkholderia* virus Bcep781, *Burkholderia* virus BcepNY3, *Xanthomonas* virus OP2, *Burkholderia* virus BcepMu, *Burkholderia* virus phiE255, *Aeromonas* virus 44RR2, *Mycobacterium* virus Alice, *Mycobacterium* virus Bxz1, *Mycobacterium* virus Dandelion, *Mycobacterium* virus HyRo, *Mycobacterium* virus 13, *Mycobacterium* virus Nappy, *Mycobacterium* virus Sebata, *Clostridium* virus phiC2, *Clostridium* virus phiCD27, *Clostridium* virus phiCD119, *Bacillus* virus CP51, *Bacillus* virus JL, *Bacillus* virus Shanette, *Escherichia* virus CVM10, *Escherichia* virus ep3, *Erwinia* virus Asesino, *Erwinia* virus EaH2, *Pseudomonas* virus EL, *Halomonas* virus HAP1, *Vibrio* virus VP882, *Brevibacillus* virus Jimmer, *Brevibacillus* virus Osiris, *Pseudomonas* virus Ab03, *Pseudomonas* virus KPP10, *Pseudomonas* virus PAKP3, *Sinorhizobium* virus M7, *Sinorhizobium* virus M12, *Sinorhizobium* virus N3, *Erwinia* virus Machina, *Arthrobacter* virus Brent, *Arthrobacter* virus Jawnski, *Arthrobacter* virus Martha, *Arthrobacter* virus Sonny, *Edwardsiella* virus MSW3, *Edwardsiella* virus PEi21, *Escherichia* virus Mu, *Shigella* virus SfMu, *Halobacterium* virus phiH, *Bacillus* virus Grass, *Bacillus* virus NIT1, *Bacillus* virus SPG24, *Aeromonas* virus 43, *Escherichia* virus P1, *Pseudomonas* virus CAb1, *Pseudomonas* virus CAb02, *Pseudomonas* virus JG004, *Pseudomonas* virus PAKP1, *Pseudomonas* virus PAKP4, *Pseudomonas* virus PaP1, *Burkholderia* virus BcepF 1, *Pseudomonas* virus 141, *Pseudomonas* virus Ab28, *Pseudomonas* virus DL60, *Pseudomonas* virus DL68, *Pseudomonas* virus F8, *Pseudomonas* virus JG024, *Pseudomonas* virus KPP12, *Pseudomonas* virus LBL3, *Pseudomonas* virus LMA2, *Pseudomonas* virus PB1, *Pseudomonas* virus SN, *Pseudomonas* virus PA7, *Pseudomonas* virus phiKZ, *Rhizobium* virus RHEph4, *Ralstonia* virus RSF1, *Ralstonia* virus RSL2, *Ralstonia* virus RSL1, *Aeromonas* virus 25, *Aeromonas* virus 31, *Aeromonas* virus Aes12, *Aeromonas* virus Aes508, *Aeromonas* virus AS4, *Stenotrophomonas* virus IME13, *Staphylococcus* virus IPLAC1C, *Staphylococcus* virus SEP1, *Salmonella* virus SPN3US, *Bacillus* virus 1, *Geobacillus* virus GBSV1, *Yersinia* virus R1RT, *Yersinia* virus TG1, *Bacillus* virus G, *Bacillus* virus PBS1, *Microcystis* virus Ma-LMM01, *Vibrio* virus MAR, *Vibrio* virus VHML, *Vibrio* virus VP585, *Bacillus* virus BPS13, *Bacillus* virus Hakuna, *Bacillus* virus Megatron, *Bacillus* virus WPh, *Acinetobacter* virus AB3, *Acinetobacter* virus Abp 1, *Acinetobacter* virus Fri1, *Acinetobacter* virus IME200, *Acinetobacter* virus PD6A3, *Acinetobacter* virus PDAB9, *Acinetobacter* virus phiAB 1, *Escherichia* virus K30, *Klebsiella* virus K5, *Klebsiella* virus K11, *Klebsiella* virus Kp1, *Klebsiella* virus KP32, *Klebsiella* virus KpV289, *Klebsiella* virus F19, *Klebsiella* virus K244, *Klebsiella* virus Kp2, *Klebsiella* virus KP34, *Klebsiella* virus KpV41, *Klebsiella* virus KpV71, *Klebsiella* virus KpV475, *Klebsiella* virus SU503, *Klebsiella* virus SU552A, *Pantoea* virus Limelight, *Pantoea* virus Limezero, *Pseudomonas* virus LKA1, *Pseudomonas* virus phiKMV, *Xanthomonas* virus f20, *Xanthomonas* virus f30, *Xylella* virus Prado, *Erwinia* virus Era103, *Escherichia* virus K5, *Escherichia* virus K1-5, *Escherichia* virus K1E, *Salmonella* virus SP6, *Escherichia* virus T7, *Kluyvera* virus Kvp1, *Pseudomonas* virus gh1, *Prochlorococcus* virus PSSP7, *Synechococcus* virus P60, *Synechococcus* virus Syn5, *Streptococcus* virus Cp1, *Streptococcus* virus Cp7, *Staphylococcus* virus 44AHJD, *Streptococcus* virus C1, *Bacillus* virus B103, *Bacillus* virus GA1, *Bacillus* virus phi29, *Kurthia* virus 6, *Actinomyces* virus Av1, *Mycoplasma* virus P1, *Escherichia* virus 24B, *Escherichia* virus 933W, *Escherichia* virus Min27, *Escherichia* virus PA28, *Escherichia* virus Stx2 II, *Shigella* virus 7502Stx, *Shigella* virus POCJ13, *Escherichia* virus 191, *Escherichia* virus PA2, *Escherichia* virus TL2011, *Shigella* virus VASD, *Burkholderia* virus Bcep22, *Burkholderia* virus Bcepi102, *Burkholderia* virus Bcepmig1, *Burkholderia* virus DC1, *Bordetella* virus BPP1, *Burkholderia* virus BcepC6B, *Cellulophaga* virus Cba41, *Cellulophaga* virus Cba172, *Dinoroseobacter* virus DFL12, *Erwinia* virus Ea9-2, *Erwinia* virus Frozen, *Escherichia* virus phiV10, *Salmonella* virus Epsilon15, *Salmonella* virus SPN1S, *Pseudomonas* virus F116, *Pseudomonas* virus H66, *Escherichia* virus APEC5, *Escherichia* virus APEC7, *Escherichia* virus Bp4, *Escherichia* virus EC1UPM, *Escherichia* virus ECBP1, *Escherichia* virus G7C, *Escherichia* virus IME11, *Shigella* virus Sb 1, *Achromobacter* virus Axp3, *Achromobacter* virus JWAlpha, *Edwardsiella* virus KF1, *Pseudomonas* virus KPP25, *Pseudomonas* virus R18, *Pseudomonas* virus Ab09, *Pseudomonas* virus LIT1, *Pseudomonas* virus PA26, *Pseudomonas* virus Ab22, *Pseudomonas* virus CHU, *Pseudomonas* virus LUZ24, *Pseudomonas* virus PAA2, *Pseudomonas* virus PaP3, *Pseudomonas* virus PaP4, *Pseudomonas* virus TL, *Pseudomonas* virus KPP21, *Pseudomonas* virus LUZ7, *Escherichia* virus N4, *Salmonella* virus 9NA, *Salmonella* virus SP069, *Salmonella* virus BTP1, *Salmonella* virus HK620, *Salmonella* virus P22, *Salmonella* virus ST64T, *Shigella* virus Sf6, *Bacillus* virus Page, *Bacillus* virus Palmer, *Bacillus* virus Pascal, *Bacillus* virus Pony, *Bacillus* virus Pookie, *Escherichia* virus 172-1, *Escherichia* virus ECB2, *Escherichia* virus NJ01, *Escherichia* virus phiEco32, *Escherichia* virus Septima11, *Escherichia* virus SU10, *Brucella* virus Pr, *Brucella* virus Tb, *Escherichia* virus Pollock, *Salmonella* virus FSL SP-058, *Salmonella* virus FSL SP-076, *Helicobacter* virus 1961P, *Helicobacter* virus KHP30, *Helicobacter* virus KHP40, *Hamiltonella* virus APSE1, *Lactococcus* virus KSY1, *Phormidium* virus WMP3, *Phormidium* virus WMP4, *Pseudomonas* virus 119X, *Roseobacter* virus SIO1, *Vibrio* virus VpV262, *Vibrio* virus VC8, *Vibrio* virus VP2, *Vibrio* virus VP5, *Streptomyces* virus Amela, *Streptomyces* virus phiCAM, *Streptomyces* virus Aaronocolus, *Streptomyces* virus Caliburn, *Streptomyces* virus Danzina, *Streptomyces* virus Hydra, *Streptomyces* virus Izzy, *Streptomyces* virus Lannister, *Streptomyces* virus Lika, *Streptomyces* virus Sujidade, *Streptomyces* virus Zemlya, *Streptomyces* virus ELB20, *Streptomyces* virus R4, *Streptomyces* virus phiHau3, *Mycobacterium* virus Acadian, *Mycobacterium* virus Baee, *Mycobacterium* virus Reprobate, *Mycobacterium* virus Adawi, *Mycobacterium* virus Bane 1, *Mycobacterium* virus BrownCNA, *Mycobacterium* virus Chrisnmich, *Mycobacterium* virus Cooper, *Mycobacterium* virus JAMaL, *Mycobacterium* virus Nigel, *Mycobacterium* virus Stinger, *Mycobacterium* virus Vincenzo, *Mycobacterium* virus Zemanar, *Mycobacterium* virus Apizium, *Mycobacterium* virus Manad, *Mycobacterium* virus Oline, *Mycobacterium* virus Osmaximus, *Mycobacterium* virus Pg1, *Mycobacterium* virus Soto, *Mycobacterium* virus Suffolk, *Mycobacterium* virus Athena, *Mycobacterium* virus Bernardo, *Mycobacterium* virus Gadjet, *Mycobacterium* virus Pipefish, *Mycobacterium* virus Godines, *Mycobacterium* virus Rosebush, *Mycobacterium* virus Babsiella, *Mycobacterium* virus Brujita, *Mycobacterium* virus Che9c, *Mycobacterium* virus Sbash, *Mycobacterium* virus Hawkeye, *Mycobacterium* virus Plot, *Salmonella* virus AG11, *Salmonella* virus Ent1, *Salmonella* virus fl8SE, *Salmonella* virus Jersey, *Salmonella* virus L13, *Salmonella* virus LSPA1, *Salmonella* virus SE2, *Salmonella* virus SETP3, *Salmonella* virus SETP7, *Salmonella* virus SETP13, *Salmonella* virus SP101, *Salmonella* virus SS3e, *Salmonella* virus wksl3, *Escherichia* virus K1G, *Escherichia* virus K1H, *Escherichia* virus Klind1, *Escherichia* virus Klind2, *Salmonella* virus SP31, *Leuconostoc* virus Lmd1, *Leuconostoc* virus LN03, *Leuconostoc* virus LN04, *Leuconostoc* virus LN12, *Leuconostoc* virus LN6B, *Leuconostoc* virus P793, *Leuconostoc* virus 1A4, *Leuconostoc* virus Ln8, *Leuconostoc* virus Ln9, *Leuconostoc* virus LN25, *Leuconostoc* virus LN34, *Leuconostoc* virus LNTR3, *Mycobacterium* virus Bongo, *Mycobacterium* virus Rey, *Mycobacterium* virus Butters, *Mycobacterium* virus Michelle, *Mycobacterium* virus Charlie, *Mycobacterium* virus Pipsqueaks, *Mycobacterium* virus Xeno, *Mycobacterium* virus Panchino, *Mycobacterium* virus Phrann, *Mycobacterium* virus Redi, *Mycobacterium* virus Skinnyp, *Gordonia* virus BaxterFox, *Gordonia* virus Yeezy, *Gordonia* virus Kita, *Gordonia* virus Zirinka, *Gorrdonia* virus Nymphadora, *Mycobacterium* virus Bignuz, *Mycobacterium* virus Brusacoram, *Mycobacterium* virus Donovan, *Mycobacterium* virus Fishburne, *Mycobacterium* virus Jebeks, *Mycobacterium* virus Malithi, *Mycobacterium* virus Phayonce, *Enterobacter* virus F20, *Klebsiella* virus 1513, *Klebsiella* virus KLPN1, *Klebsiella* virus KP36, *Klebsiella* virus PKP126, *Klebsiella* virus Sushi, *Escherichia* virus AHP42, *Escherichia* virus AHS24, *Escherichia* virus AKS96, *Escherichia* virus C119, *Escherichia* virus E41c, *Escherichia* virus Eb49, *Escherichia* virus Jk06, *Escherichia* virus KP26, *Escherichia* virus Rogue1, *Escherichia* virus ACGM12, *Escherichia* virus Rtp, *Escherichia* virus ADB2, *Escherichia* virus JMPW1, *Escherichia* virus JMPW2, *Escherichia* virus T1, *Shigella* virus PSf2, *Shigella* virus Shf11, *Citrobacter* virus Stevie, *Escherichia* virus TLS, *Salmonella* virus SP126, *Cronobacter* virus Esp2949-1, *Pseudomonas* virus Ab 18, *Pseudomonas* virus Ab 19, *Pseudomonas* virus PaMx11, *Arthrobacter* virus Amigo, *Propionibacterium* virus Anatole, *Propionibacterium* virus B3, *Bacillus* virus Andromeda, *Bacillus* virus Blastoid, *Bacillus* virus Curly, *Bacillus* virus Eoghan, *Bacillus* virus Finn, *Bacillus* virus Glittering, *Bacillus* virus Riggi, *Bacillus* virus Taylor, *Gordonia* virus Attis, *Mycobacterium* virus Barnyard, *Mycobacterium* virus Konstantine, *Mycobacterium* virus Predator, *Mycobacterium* virus Bernal13, *Staphylococcus* virus 13, *Staphylococcus* virus 77, *Staphylococcus* virus 108PVL, *Mycobacterium* virus Bron, *Mycobacterium* virus Faith1, *Mycobacterium* virus Joedirt, *Mycobacterium* virus Rumpelstiltskin, *Lactococcus* virus bIL67, *Lactococcus* virus c2, *Lactobacillus* virus c5, *Lactobacillus* virus Ld3, *Lactobacillus* virus Ldl7, *Lactobacillus* virus Ld25A, *Lactobacillus* virus LLKu, *Lactobacillus* virus phiLdb, *Cellulophaga* virus Cba121, *Cellulophaga* virus Cba171, *Cellulophaga* virus Cba181, *Cellulophaga* virus ST, *Bacillus* virus 250, *Bacillus* virus IEBH, *Mycobacterium* virus Ardmore, *Mycobacterium* virus Avani, *Mycobacterium* virus Boomer, *Mycobacterium* virus Che8, *Mycobacterium* virus Che9d, *Mycobacterium* virus Deadp, *Mycobacterium* virus Dlane, *Mycobacterium* virus Dorothy, *Mycobacterium* virus Dotproduct, *Mycobacterium* virus Drago, *Mycobacterium* virus Fruitloop, *Mycobacterium* virus Gumbie, *Mycobacterium* virus Ibhubesi, *Mycobacterium* virus Llij, *Mycobacterium* virus Mozy, *Mycobacterium* virus Mutaforma13, *Mycobacterium* virus Pacc40, *Mycobacterium* virus PMC, *Mycobacterium* virus Ramsey, *Mycobacterium* virus Rockyhorror, *Mycobacterium* virus SG4, *Mycobacterium* virus Shauna1, *Mycobacterium* virus Shilan, *Mycobacterium* virus Spartacus, *Mycobacterium* virus Taj, *Mycobacterium* virus Tweety, *Mycobacterium* virus Wee, *Mycobacterium* virus Yoshi, *Salmonella* virus Chi, *Salmonella* virus FSLSP030, *Salmonella* virus FSLSP088, *Salmonella* virus iEPS5, *Salmonella* virus SPN19, *Mycobacterium* virus 244,

*Mycobacterium* virus Bask21, *Mycobacterium* virus CJW1, *Mycobacterium* virus Eureka, *Mycobacterium* virus Kostya, *Mycobacterium* virus Porky, *Mycobacterium* virus Pumpkin, *Mycobacterium* virus Sirduracell, *Mycobacterium* virus Toto, *Mycobacterium* virus Corndog, *Mycobacterium* virus Firecracker, *Rhodobacter* virus RcCronus, *Pseudomonas* virus D3112, *Pseudomonas* virus DMS3, *Pseudomonas* virus FHA0480, *Pseudomonas* virus LPB 1, *Pseudomonas* virus MP22, *Pseudomonas* virus MP29, *Pseudomonas* virus MP38, *Pseudomonas* virus PAlKOR, *Pseudomonas* virus D3, *Pseudomonas* virus PMG1, *Arthrobacter* virus Decurro, *Gordonia* virus Demosthenes, *Gordonia* virus Katyusha, *Gordonia* virus Kvothe, *Propionibacterium* virus B22, *Propionibacterium* virus Doucette, *Propionibacterium* virus E6, *Propionibacterium* virus G4, *Burkholderia* virus phi6442, *Burkholderia* virus phi1026b, *Burkholderia* virus phiE125, *Edwardsiella* virus eiAU, *Mycobacterium* virus Ff47, *Mycobacterium* virus Muddy, *Mycobacterium* virus Gaia, *Mycobacterium* virus Giles, *Arthrobacter* virus Captnmurica, *Arthrobacter* virus Gordon, *Gordonia* virus GordTnk2, *Paenibacillus* virus Harrison, *Escherichia* virus EK99P1, *Escherichia* virus HK578, *Escherichia* virus JL1, *Escherichia* virus SSL2009a, *Escherichia* virus YD2008s, *Shigella* virus EP23, *Sodalis* virus SO1, *Escherichia* virus HK022, *Escherichia* virus HK75, *Escherichia* virus HK97, *Escherichia* virus HK106, *Escherichia* virus HK446, *Escherichia* virus HK542, *Escherichia* virus HK544, *Escherichia* virus HK633, *Escherichia* virus mEp234, *Escherichia* virus mEp235, *Escherichia* virus mEpX1, *Escherichia* virus mEpX2, *Escherichia* virus mEp043, *Escherichia* virus mEp213, *Escherichia* virus mEp237, *Escherichia* virus mEp390, *Escherichia* virus mEp460, *Escherichia* virus mEp505, *Escherichia* virus mEp506, *Brevibacillus* virus Jenst, *Achromobacter* virus 83-24, *Achromobacter* virus JWX, *Arthrobacter* virus Kellezzio, *Arthrobacter* virus Kitkat, *Arthrobacter* virus Bennie, *Arthrobacter* virus DrRobert, *Arthrobacter* virus Glenn, *Arthrobacter* virus HunterDalle, *Arthrobacter* virus Joann, *Arthrobacter* virus Korra, *Arthrobacter* virus Preamble, *Arthrobacter* virus Pumancara, *Arthrobacter* virus Wayne, *Mycobacterium* virus Alma, *Mycobacterium* virus Arturo, *Mycobacterium* virus Astro, *Mycobacterium* virus Backyardigan, *Mycobacterium* virus BBPiebs31, *Mycobacterium* virus Benedict, *Mycobacterium* virus Bethlehem, *Mycobacterium* virus Billknuckles, *Mycobacterium* virus Bruns, *Mycobacterium* virus Bxb 1, *Mycobacterium* virus Bxz2, *Mycobacterium* virus Chel2, *Mycobacterium* virus Cuco, *Mycobacterium* virus D29, *Mycobacterium* virus Doom, *Mycobacterium* virus Ericb, *Mycobacterium* virus Euphoria, *Mycobacterium* virus George, *Mycobacterium* virus Gladiator, *Mycobacterium* virus Goose, *Mycobacterium* virus Hammer, *Mycobacterium* virus Heldan, *Mycobacterium* virus Jasper, *Mycobacterium* virus JC27, *Mycobacterium* virus Jeffabunny, *Mycobacterium* virus JHC117, *Mycobacterium* virus KBG, *Mycobacterium* virus Kssjeb, *Mycobacterium* virus Kugel, *Mycobacterium* virus L5, *Mycobacterium* virus Lesedi, *Mycobacterium* virus LHTSCC, *Mycobacterium* virus lockley, *Mycobacterium* virus Marcell, *Mycobacterium* virus Microwolf, *Mycobacterium* virus Mrgordo, *Mycobacterium* virus Museum, *Mycobacterium* virus Nepal, *Mycobacterium* virus Packman, *Mycobacterium* virus Peaches, *Mycobacterium* virus Perseus, *Mycobacterium* virus Pukovnik, *Mycobacterium* virus Rebeuca, *Mycobacterium* virus Redrock, *Mycobacterium* virus Ridgecb, *Mycobacterium* virus Rockstar, *Mycobacterium* virus Saintus, *Mycobacterium* virus Skipole, *Mycobacterium* virus Solon, *Mycobacterium* virus Switzer, *Mycobacterium* virus SWU1, *Mycobacterium* virus Tal7a, *Mycobacterium* virus Tiger, *Mycobacterium* virus Timshel, *Mycobacterium* virus Trixie, *Mycobacterium* virus Turbido, *Mycobacterium* virus Twister, *Mycobacterium* virus U2, *Mycobacterium* virus Violet, *Mycobacterium* virus Wonder, *Escherichia* virus DE3, *Escherichia* virus HK629, *Escherichia* virus HK630, *Escherichia* virus lambda, *Arthrobacter* virus Laroye, *Mycobacterium* virus Halo, *Mycobacterium* virus Liefie, *Mycobacterium* virus Marvin, *Mycobacterium* virus Mosmoris, *Arthrobacter* virus Circum, *Arthrobacter* virus Mudcat, *Escherichia* virus N15, *Escherichia* virus 9g, *Escherichia* virus JenKi, *Escherichia* virus JenP1, *Escherichia* virus JenP2, *Pseudomonas* virus NP1, *Pseudomonas* virus PaMx25, *Mycobacterium* virus Baka, *Mycobacterium* virus Courthouse, *Mycobacterium* virus Littlee, *Mycobacterium* virus Omega, *Mycobacterium* virus Optimus, *Mycobacterium* virus Thibault, *Polaribacter* virus P12002L, *Polaribacter* virus P12002S, *Nonlabens* virus P12024L, *Nonlabens* virus P12024S, *Thermus* virus P23-45, *Thermus* virus P74-26, *Listeria* virus LP26, *Listeria* virus LP37, *Listeria* virus LP110, *Listeria* virus LP114, *Listeria* virus P70, *Propionibacterium* virus ATCC29399BC, *Propionibacterium* virus ATCC29399BT, *Propionibacterium* virus Attacne, *Propionibacterium* virus Keiki, *Propionibacterium* virus Kubed, *Propionibacterium* virus Lauchelly, *Propionibacterium* virus MrAK, *Propionibacterium* virus Ouroboros, *Propionibacterium* virus P91, *Propionibacterium* virus P105, *Propionibacterium* virus P144, *Propionibacterium* virus P1001, *Propionibacterium* virus P1.1, *Propionibacterium* virus P100A, *Propionibacterium* virus P100D, *Propionibacterium* virus P101A, *Propionibacterium* virus P104A, *Propionibacterium* virus PA6, *Propionibacterium* virus Pacnes201215, *Propionibacterium* virus PAD20, *Propionibacterium* virus PAS50, *Propionibacterium* virus PHL009M11, *Propionibacterium* virus PHL025M00, *Propionibacterium* virus PHL037M02, *Propionibacterium* virus PHLO41M10, *Propionibacterium* virus PHLO60LOO, *Propionibacterium* virus PHLO67M01, *Propionibacterium* virus PHLO70N00, *Propionibacterium* virus PHLO71N05, *Propionibacterium* virus PHLO82MO3, *Propionibacterium* virus PHLO92M00, *Propionibacterium* virus PHLO95N00, *Propionibacterium* virus PHL111M01, *Propionibacterium* virus PHL112N00, *Propionibacterium* virus PHL113M01, *Propionibacterium* virus PHL114L00, *Propionibacterium* virus PHL116M00, *Propionibacterium* virus PHL117M00, *Propionibacterium* virus PHL117M01, *Propionibacterium* virus PHL132N00, *Propionibacterium* virus PHL141N00, *Propionibacterium* virus PHL151M00, *Propionibacterium* virus PHL151N00, *Propionibacterium* virus PHL152M00, *Propionibacterium* virus PHL163M00, *Propionibacterium* virus PHL171M01, *Propionibacterium* virus PHL179M00, *Propionibacterium* virus PHL194M00, *Propionibacterium* virus PHL199M00, *Propionibacterium* virus PHL301M00, *Propionibacterium* virus PHL308M00, *Propionibacterium* virus Pirate, *Propionibacterium* virus Procrassl, *Propionibacterium* virus SKKY, *Propionibacterium* virus Solid, *Propionibacterium* virus Stormborn, *Propionibacterium* virus Wizzo, *Pseudomonas* virus PaMx28, *Pseudomonas* virus PaMx74, *Mycobacterium* virus Patience, *Mycobacterium* virus PBI1, *Rhodococcus* virus Pepy6, *Rhodococcus* virus Poco6, *Propionibacterium* virus PFR1, *Streptomyces* virus phiBT1, *Streptomyces* virus phiC31, *Streptomyces* virus TG1, *Caulobacter* virus Karma, *Caulobacter* virus Magneto, *Caulobacter* virus phiCbK, *Caulobacter* virus Rogue, *Caulobacter* virus Swift, *Staphylococcus* virus 11, *Staphylococcus* virus 29, *Staphylococcus* virus 37, *Staphylococcus* virus 53, *Staphylococcus* virus 55, *Staphylococcus* virus 69, Staphylococcus virus 71, Staphylococcus virus 80, Staphylococcus virus 85, Staphylococcus virus 88, Staphylococcus virus 92, Staphylococcus virus 96, Staphylococcus virus 187, Staphylococcus virus 52a, Staphylococcus virus 80alpha, Staphylococcus virus CNPH82, Staphylococcus virus EW, Staphylococcus virus IPLA5, Staphylococcus virus IPLA7, Staphylococcus virus IPLA88, Staphylococcus virus PH15, Staphylococcus virus phiETA, Staphylococcus virus phiETA2, Staphylococcus virus phiETA3, Staphylococcus virus phiMR11, Staphylococcus virus phiMR25, Staphylococcus virus phiNM1, Staphylococcus virus phiNM2, Staphylococcus virus phiNM4, Staphylococcus virus SAP26, Staphylococcus virus X2, Enterococcus virus FL1, Enterococcus virus FL2, Enterococcus virus FL3, Lactobacillus virus ATCC8014, Lactobacillus virus phiJL1, Pediococcus virus cIP1, Aeromonas virus pIS4A, Listeria virus LP302, Listeria virus PSA, Methanobacterium virus psiM1, Roseobacter virus RDJL1, Roseobacter virus RDJL2, Rhodococcus virus RER2, Enterococcus virus BC611, Enterococcus virus IMEEF1, Enterococcus virus SAP6, Enterococcus virus VD13, Streptococcus virus SPQS1, Mycobacterium virus Papyrus, Mycobacterium virus Send513, Burkholderia virus KL1, Pseudomonas virus 73, Pseudomonas virus Ab26, Pseudomonas virus Kakheti25, Escherichia virus Cajan, Escherichia virus Seurat, Staphylococcus virus SEP9, Staphylococcus virus Sextaec, Streptococcus virus 858, Streptococcus virus 2972, Streptococcus virus ALQ132, Streptococcus virus 01205, Streptococcus virus Sfi11, Streptococcus virus 7201, Streptococcus virus DT1, Streptococcus virus phiAbc2, Streptococcus virus Sfi19, Streptococcus virus Sfi21, Paenibacillus virus Diva, Paenibacillus virus Hb 10c2, Paenibacillus virus Rani, Paenibacillus virus Shelly, Paenibacillus virus Sitara, Paenibacillus virus Willow, Lactococcus virus 712, Lactococcus virus ASCC191, Lactococcus virus ASCC273, Lactococcus virus ASCC281, Lactococcus virus ASCC465, Lactococcus virus ASCC532, Lactococcus virus Bibb29, Lactococcus virus bIL170, Lactococcus virus CB13, Lactococcus virus CB14, Lactococcus virus CB19, Lactococcus virus CB20, Lactococcus virus jj50, Lactococcus virus P2, Lactococcus virus P008, Lactococcus virus sk1, Lactococcus virus S14, Bacillus virus Slash, Bacillus virus Stahl, Bacillus virus Staley, Bacillus virus Stills, Gordonia virus Bachita, Gordonia virus ClubL, Gordonia virus OneUp, Gordonia virus Smoothie, Gordonia virus Soups, Bacillus virus SPbeta, Vibrio virus MARiO, Vibrio virus SSP002, Escherichia virus AKFV33, Escherichia virus BF23, Escherichia virus DT57C, Escherichia virus EPS7, Escherichia virus FFH1, Escherichia virus H8, Escherichia virus slur09, Escherichia virus T5, Salmonella virus 118970sa12, Salmonella virus Shivani, Salmonella virus SPC35, Salmonella virus Stitch, Arthrobacter virus Tank, Tsukamurella virus TIN2, Tsukamurella virus TIN3, Tsukamurella virus TIN4, Rhodobacter virus RcSpartan, Rhodobacter virus RcTitan, Mycobacterium virus Anaya, Mycobacterium virus Angelica, Mycobacterium virus Crimd, Mycobacterium virus Fionnbarth, Mycobacterium virus Jaws, Mycobacterium virus Larva, Mycobacterium virus Macncheese, Mycobacterium virus Pixie, Mycobacterium virus TM4, Bacillus virus BMBtp2, Bacillus virus TP21, Geobacillus virus Tp84, Staphylococcus virus 47, Staphylococcus virus 3a, Staphylococcus virus 42e, Staphylococcus virus IPLA35, Staphylococcus virus phi12, Staphylococcus virus phi SLT, Mycobacterium virus 32HC, Rhodococcus virus RGL3, Paenibacillus virus Vegas, Gordonia virus Vendetta, Bacillus virus Wbeta, Mycobacterium virus Wildcat, Gordonia virus Twister6, Gordonia virus Wizard, Gordonia virus Hotorobo, Gordonia virus Monty, Gordonia virus Woes, Xanthomonas virus CP1, Xanthomonas virus OP1, Xanthomonas virus phi17, Xanthomonas virus Xop411, Xanthomonas virus Xp10, Streptomyces virus TP1604, Streptomyces virus YDN12, Alphaproteobacteria virus phiJ1001, Pseudomonas virus LKO4, Pseudomonas virus M6, Pseudomonas virus MP1412, Pseudomonas virus PAE1, Pseudomonas virus Yua, Pseudoalteromonas virus PM2, Pseudomonas virus phi6, Pseudomonas virus phi8, Pseudomonas virus phi12, Pseudomonas virus phi13, Pseudomonas virus phi2954, Pseudomonas virus phiNN, Pseudomonas virus phiYY, Vibrio virus fs1, Vibrio virus VGJ, Ralstonia virus RS603, Ralstonia virus RSM1, Ralstonia virus RSM3, Escherichia virus M13, Escherichia virus 122, Salmonella virus IKe, Acholeplasma virus L51, Vibrio virus fs2, Vibrio virus VFJ, Escherichia virus If1, Propionibacterium virus B5, Pseudomonas virus Pf1, Pseudomonas virus Pf3, Ralstonia virus PE226, Ralstonia virus RSS1, Spiroplasma virus SVTS2, Stenotrophomonas virus PSH1, Stenotrophomonas virus SMA6, Stenotrophomonas virus SMA7, Stenotrophomonas virus SMA9, Vibrio virus CTXphi, Vibrio virus KSF1, Vibrio virus VCY, Vibrio virus Vf33, Vibrio virus VfO3K6, Xanthomonas virus Cflc, Spiroplasma virus C74, Spiroplasma virus R8A2B, Spiroplasma virus SkV1CR23x, Escherichia virus FI, Escherichia virus Qbeta, Escherichia virus BZ 13, Escherichia virus MS2, Escherichia virus alpha3, Escherichia virus ID21, Escherichia virus ID32, Escherichia virus ID62, Escherichia virus NC28, Escherichia virus NC29, Escherichia virus NC35, Escherichia virus phiK, Escherichia virus St1, Escherichia virus WA45, Escherichia virus G4, Escherichia virus ID52, Escherichia virus Talmos, Escherichia virus phiX174, Bdellovibrio virus MAC 1, Bdellovibrio virus MH2K, Chlamydia virus Chp1, Chlamydia virus Chp2, Chlamydia virus CPAR39, Chlamydia virus CPG1, Spiroplasma virus SpV4, Acholeplasma virus L2, Pseudomonas virus PR4, Pseudomonas virus PRD1, Bacillus virus AP50, Bacillus virus Bam35, Bacillus virus GIL16, Bacillus virus Wip1, Escherichia virus phi80, Escherichia virus RB42, Escherichia virus T2, Escherichia virus T3, Escherichia virus T6, Escherichia virus VT2-Sa, Escherichia virus VT1-Sakai, Escherichia virus VT2-Sakai, Escherichia virus CP-933V, Escherichia virus P27, Escherichia virus Stx2phi-I, Escherichia virus Stx1phi, Escherichia virus Stx2phi-II, Escherichia virus CP-1639, based on the Escherichia virus BP-4795, Escherichia virus 86, Escherichia virus Min27, Escherichia virus 2851, Escherichia virus 1717, Escherichia virus YYZ-2008, Escherichia virus EC026 P06, Escherichia virus ECO103 P15, Escherichia virus ECO103 P12, Escherichia virus ECO111_P16, Escherichia virus ECO111_P11, Escherichia virus VT2phi_272, Escherichia virus TL-2011c, Escherichia virus P13374, Escherichia virus Sp5.

In one embodiment, the bacterial virus particles target E. coli and includes the capsid of a bacteriophage selected in the group consisting of BW73, B278, D6, D108, E, E1, E24, E41, FI-2, FI-4, FI-5, HI8A, Ffl8B, i, MM, Mu, 025, PhI-5, Pk, PSP3, P1, P1D, P2, P4, S1, Wφ, φK13, φ1, φ2, φ7, φ92, 7 A, 8φ, 9φ, 18, 28-1, 186, 299, HH-Escherichia (2), AB48, CM, C4, C16, DD-VI, E4, E7, E28, FI, FI3, H, H1, H3, H8, K3, M, N, ND-2, ND-3, ND4, ND-5, ND6, ND-7, Ox-I, Ox-2, Ox-3, Ox-4, Ox-5, Ox-6, PhI-I, RB42, RB43, RB49, RB69, S, Sal-I, Sal-2, Sal-3, Sal-4, Sal-5, Sal-6, TC23, TC45, TuII*-6, TuIP-24, TuII*46, TuIP-60, T2, T4, T6, T35, α1, 1, IA, 3, 3A, 3T+, 5qp, 9266Q, CFO103, HK620, J, K, K1F, m59, no. A, no. E, no. 3, no. 9, N4, sd, T3, T7, WPK, W31, ΔH, φC3888, φK3, φK7, φK12, φV-1, Φ04-CF, Φ05, Φ06, Φ07, φ1, φ1.2, φ20, φ95, φ263, φ1O92, φ1, φ11, Ω8, 1, 3, 7, 8, 26, 27, 28-2, 29, 30, 31, 32, 38, 39, 42, 933W, NN-*Escherichia* (1), Esc-7-11, AC30, CVX-5, C1, DDUP, EC1, EC2, E21, E29, F1, F26S, F27S, Hi, HK022, HK97, HK139, HK253, HK256, K7, ND-I, PA-2, q, S2, T1,), T3C, T5, UC-I, w, β4, γ2, λ, ΦD326, φγ, Φ06, Φ7, Φ10, φ80, χ, 2, 4, 4A, 6, 8A, 102, 150, 168, 174, 3000, AC6, AC7, AC28, AC43, AC50, AC57, AC81, AC95, HK243, K1O, ZG/3A, 5, 5A, 21EL, H19-J and 933H.

Prebiotics include, but are not limited to, amino acids, biotin, fructo-oligosaccharide, galacto-oligosaccharides, hemicelluloses (e.g., arabinoxylan, xylan, xyloglucan, and glucomannan), inulin, chitin, lactulose, mannan oligosaccharides, oligofructose-enriched inulin, gums (e.g., guar gum, gum arabic and carregenaan), oligofructose, oligodextrose, tagatose, resistant maltodextrins (e.g., resistant starch), trans-galactooligosaccharide, pectins (e.g., xylogalactouronan, citrus pectin, apple pectin, and rhamnogalacturonan-I), dietary fibers (e.g., soy fiber, sugarbeet fiber, pea fiber, corn bran, and oat fiber) and xylooligosaccharides.

Probiotics include, but are not limited to lactobacilli, bifidobacteria, streptococci, enterococci, propionibacteria, saccaromycetes, lactobacilli, bifidobacteria, or proteobacteria.

The antibiotic can be selected from the group consisting in penicillins such as penicillin G, penicillin K, penicillin N, penicillin O, penicillin V, methicillin, benzylpenicillin, nafcillin, oxacillin, cloxacillin, dicloxacillin, ampicillin, amoxicillin, pivampicillin, hetacillin, bacampicillin, metampicillin, talampicillin, epicillin, carbenicillin, ticarcillin, temocillin, mezlocillin, and piperacillin; cephalosporins such as cefacetrile, cefadroxil, cephalexin, cefaloglycin, cefalonium, cefaloridine, cefalotin, cefapirin, cefatrizine, cefazaflur, cefazedone, cefazolin, cefradine, cefroxadine, ceftezole, cefaclor, cefonicid, cefprozil, cefuroxime, cefuzonam, cefmetazole, cefotetan, cefoxitin, loracarbef, cefbuperazone, cefminox, cefotetan, cefoxitin, cefotiam, cefcapene, cefdaloxime, cefdinir, cefditoren, cefetamet, cefixime, cefmenoxime, cefodizime, cefotaxime, cefovecin, cefpimizole, cefpodoxime, cefteram, ceftamere, ceftibuten, ceftiofur, ceftiolene, ceftizoxime, ceftriaxone, cefoperazone, ceftazidime, latamoxef, cefclidine, cefepime, cefluprenam, cefoselis, cefozopran, cefpirome, cefquinome, flomoxef, ceftobiprole, ceftaroline, ceftolozane, cefaloram, cefaparole, cefcanel, cefedrolor, cefempidone, cefetrizole, cefivitril, cefmatilen, cefmepidium, cefoxazole, cefrotil, cefsumide, ceftioxide, cefuracetime, and nitrocefin; polymyxins such as polysporin, neosporin, polymyxin B, and polymyxin E, rifampicins such as rifampicin, rifapentine, and rifaximin; Fidaxomicin; quinolones such as cinoxacin, nalidixic acid, oxolinic acid, piromidic acid, pipemidic acid, rosoxacin, ciprofloxacin, enoxacin, fleroxacin, lomefloxacin, nadifloxacin, norfloxacin, ofloxacin, pefloxacin, rufloxacin, balofloxacin, grepafloxacin, levofloxacin, pazufloxacin, temafloxacin, tosufloxacin, clinafloxacin, gatifloxacin, gemifloxacin, moxifloxacin, sitafloxacin, trovafloxacin, prulifloxacin, delafloxacin, nemonoxacin, and zabofloxacin; sulfonamides such as sulfafurazole, sulfacetamide, sulfadiazine, sulfadimidine, sulfafurazole, sulfisomidine, sulfadoxine, sulfamethoxazole, sulfamoxole, sulfanitran, sulfadimethoxine, sulfametho-xypyridazine, sulfametoxydiazzine, sulfadoxine, sulfametopyrazine, and terephtyl; macrolides such as azithromycin, clarithromycin, erythromycin, fidaxomicin, telithromycin, carbomycin A, josamycin, kitasamycin, midecamycin, oleandomycin, solithromycin, spiramycin, troleandomycin, tylosin, and roxithromycin; ketolides such as telithromycin, and cethromycin; lluoroketolides such as solithromycin; lincosamides such as lincomycin, clindamycin, and pirlimycin; tetracyclines such as demeclocycline, doxycycline, minocycline, oxytetracycline, and tetracycline; aminoglycosides such as amikacin, dibekacin, gentamicin, kanamycin, neomycin, netilmicin, sisomicin, tobramycin, paromomycin, and streptomycin; ansamycins such as geldanamycin, herbimycin, and rifaximin; carbacephems such as loracarbef; carbapenems such as ertapenem, doripenem, imipenem (or cilastatin), and meropenem; glycopeptides such as teicoplanin, vancomycin, telavancin, dalbavancin, and oritavancin; lincosamides such as clindamycin and lincomycin; lipopeptides such as daptomycin; monobactams such as aztreonam; nitrofurans such as furazolidone, and nitrofurantoin; oxazolidinones such as linezolid, posizolid, radezolid, and torezolid; teixobactin, clofazimine, dapsone, capreomycin, cycloserine, ethambutol, ethionamide, i soniazid, pyrazinamide, rifabutin, arsphenamine, chloramphenicol, fosfomycin, fusidic acid, metronidazole, mupirocin, platensimycin, quinupristin (or dalfopristin), thiamphenicol, tigecycline, tinidazole, trimethoprim, alatrofloxacin, fidaxomycin, nalidixice acide, rifampin, derivatives and combination thereof.

The present invention provides pharmaceutical or veterinary compositions comprising one or more of the bacterial delivery vehicles disclosed herein and a pharmaceutically-acceptable carrier. Generally, for pharmaceutical use, the bacterial delivery vehicles may be formulated as a pharmaceutical preparation or compositions comprising at least one bacterial delivery vehicles and at least one pharmaceutically acceptable carrier, diluent or excipient, and optionally one or more further pharmaceutically active compounds. Such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such administration forms may be solid, semi-solid or liquid, depending on the manner and route of administration. For example, formulations for oral administration may be provided with an enteric coating that will allow the synthetic bacterial delivery vehicles in the formulation to resist the gastric environment and pass into the intestines. More generally, synthetic bacterial delivery vehicle formulations for oral administration may be suitably formulated for delivery into any desired part of the gastrointestinal tract. In addition, suitable suppositories may be used for delivery into the gastrointestinal tract. Various pharmaceutically acceptable carriers, diluents and excipients useful in bacterial delivery vehicle compositions are known to the skilled person.

Also provided are methods for treating a bacterial infection using the synthetic bacterial delivery vehicles disclosed herein. The methods include administering the synthetic bacterial delivery vehicles or compositions disclosed herein to a subject having a bacterial infection in need of treatment. In some embodiments, the subject is a mammal. In some embodiments, the subject is a human.

The pharmaceutical or veterinary composition according to the disclosure may further comprise a pharmaceutically acceptable vehicle. A solid pharmaceutically acceptable vehicle may include one or more substances which may also act as flavouring agents, lubricants, solubilisers, suspending agents, dyes, fillers, glidants, compression aids, inert binders, sweeteners, preservatives, dyes, coatings, or tablet-disintegrating agents. Suitable solid vehicles include, for example calcium phosphate, magnesium stearate, talc, sugars, lactose, dextrin, starch, gelatin, cellulose, polyvinylpyrrolidine, low melting waxes and ion exchange resins.

The pharmaceutical or veterinary composition may be prepared as a sterile solid composition that may be suspended at the time of administration using sterile water, saline, or other appropriate sterile injectable medium. The pharmaceutical or veterinary compositions of the disclosure may be administered orally in the form of a sterile solution or suspension containing other solutes or suspending agents (for example, enough saline or glucose to make the solution isotonic), bile salts, acacia, gelatin, sorbitan monoleate, polysorbate 8o (oleate esters of sorbitol and its anhydrides copolymerized with ethylene oxide) and the like. The particles according to the disclosure can also be administered orally either in liquid or solid composition form. Compositions suitable for oral administration include solid forms, such as pills, capsules, granules, tablets, and powders, and liquid forms, such as solutions, syrups, elixirs, and suspensions. Forms useful for enteral administration include sterile solutions, emulsions, and suspensions.

The bacterial delivery vehicles according to the disclosure may be dissolved or suspended in a pharmaceutically acceptable liquid vehicle such as water, an organic solvent, a mixture of both or pharmaceutically acceptable oils or fats. The liquid vehicle can contain other suitable pharmaceutical additives such as solubilisers, emulsifiers, buffers, preservatives, sweeteners, flavouring agents, suspending agents, thickening agents, colours, viscosity regulators, stabilizers or osmo-regulators. Suitable examples of liquid vehicles for oral and enteral administration include water (partially containing additives as above, e.g. cellulose derivatives, preferably sodium carboxymethyl cellulose solution), alcohols (including monohydric alcohols and polyhydric alcohols, e.g. glycols) and their derivatives, and oils (e.g. fractionated coconut oil and *arachis* oil). For parenteral administration, the vehicle can also be an oily ester such as ethyl oleate and isopropyl myristate. Sterile liquid vehicles are useful in sterile liquid form compositions for enteral administration. The liquid vehicle for pressurized compositions can be a halogenated hydrocarbon or other pharmaceutically acceptable propellant.

For transdermal administration, the pharmaceutical or veterinary composition can be formulated into ointment, cream or gel form and appropriate penetrants or detergents could be used to facilitate permeation, such as dimethyl sulfoxide, dimethyl acetamide and dimethylformamide.

For transmucosal administration, nasal sprays, rectal or vaginal suppositories can be used. The active compounds can be incorporated into any of the known suppository bases by methods known in the art. Examples of such bases include cocoa butter, polyethylene glycols (carbowaxes), polyethylene sorbitan monostearate, and mixtures of these with other compatible materials to modify the melting point or dissolution rate.

The diseases or disorders caused by bacteria may be selected from the group consisting of abdominal cramps, acne vulgaris, acute epiglottitis, arthritis, bacteraemia, bloody diarrhea, botulism, Brucellosis, brain abscess, chancroid venereal disease, *Chlamydia*, Crohn's disease, conjunctivitis, cholecystitis, colorectal cancer, polyposis, dysbiosis, Lyme disease, diarrhea, diphtheria, duodenal ulcers, endocarditis, erysipelothricosis, enteric fever, fever, glomerulonephritis, gastroenteritis, gastric ulcers, Guillain-Barre syndrome tetanus, gonorrhoea, gingivitis, inflammatory bowel diseases, irritable bowel syndrome, leptospirosis, leprosy, listeriosis, tuberculosis, Lady Widermere syndrome, Legionaire's disease, meningitis, mucopurulent conjunctivitis, multi-drug resistant bacterial infections, multi-drug resistant bacterial carriage, myonecrosis-gas gangrene, *Mycobacterium avium* complex, neonatal necrotizing enterocolitis, nocardiosis, nosocomial infection, otitis, periodontitis, phalyngitis, pneumonia, peritonitis, purpuric fever, Rocky Mountain spotted fever, shigellosis, syphilis, sinusitis, sigmoiditis, septicaemia, subcutaneous abscesses, tularaemia, tracheobronchitis, tonsillitis, typhoid fever, ulcerative colitis, urinary infection, whooping cough.

The infection caused by bacteria may be selected from the group consisting of skin infections such as acne, intestinal infections such as esophagitis, gastritis, enteritis, colitis, sigmoiditis, rectitis, and peritonitis, urinary tract infections, vaginal infections, female upper genital tract infections such as salpingitis, endometritis, oophoritis, myometritis, parametritis and infection in the pelvic peritoneum, respiratory tract infections such as pneumonia, intra-amniotic infections, odontogenic infections, endodontic infections, fibrosis, meningitis, bloodstream infections, nosocomial infection such as catheter-related infections, hospital acquired pneumonia, post-partum infection, hospital acquired gastroenteritis, hospital acquired urinary tract infections, or a combination thereof. Preferably, the infection according to the disclosure is caused by a bacterium presenting an antibiotic resistance. In a particular embodiment, the infection is caused by a bacterium as listed above in the targeted bacteria.

The disclosure concerns a pharmaceutical or veterinary composition for use in the treatment of metabolic disorder including, for example, obesity and diabetes.

In a particular embodiment, the disclosure concerns a pharmaceutical or veterinary composition for use in the treatment of pathologies involving bacteria of the human microbiome, such as inflammatory and auto-immune diseases, cancers, infections or brain disorders. Indeed, some bacteria of the microbiome, without triggering any infection, can secrete molecules that will induce and/or enhance inflammatory or auto-immune diseases or cancer development. More specifically, the present disclosure relates also to modulating microbiome composition to improve the efficacy of immunotherapies based, for example, on CAR-T (Chimeric Antigen Receptor T) cells, TIL (Tumor Infiltrating Lymphocytes) and Tregs (Regulatory T cells) also known as suppressor T cells. Modulation of the microbiome composition to improve the efficacy of immunotherapies may also include the use of immune checkpoint inhibitors well known in the art such as, without limitation, PD-1 (programmed cell death protein 1) inhibitor, PD-L1 (programmed death ligand 1) inhibitor and CTLA-4 (cytotoxic T lymphocyte associated protein 4).

Some bacteria of the microbiome can also secrete molecules that will affect the brain.

Therefore, a further object of the disclosure is a method for controlling the microbiome of a subject, comprising administering an effective amount of the pharmaceutical composition as disclosed herein in said subject.

In a particular embodiment, the disclosure also relates to a method for personalized treatment for an individual in need of treatment for a bacterial infection comprising: i) obtaining a biological sample from the individual and determining a group of bacterial DNA sequences from the sample; ii) based on the determining of the sequences, identifying one or more pathogenic bacterial strains or species that were in the sample; and iii) administering to the individual a pharmaceutical composition according to the disclosure capable of recognizing each pathogenic bacterial strain or species identified in the sample and to deliver the packaged plasmid.

Preferably, the biological sample comprises pathological and non-pathological bacterial species, and subsequent to administering the pharmaceutical or veterinary composition according to the disclosure to the individual, the amount of pathogenic bacteria on or in the individual are reduced, but the amount of non-pathogenic bacteria is not reduced.

In another particular embodiment, the disclosure concerns a pharmaceutical or veterinary composition according to the disclosure for use in order to improve the effectiveness of drugs. Indeed, some bacteria of the microbiome, without being pathogenic by themselves, are known to be able to metabolize drugs and to modify them in ineffective or harmful molecules.

In another particular embodiment, the disclosure concerns the in-situ bacterial production of any compound of interest, including therapeutic compound such as prophylactic and therapeutic vaccine for mammals. The compound of interest can be produced inside the targeted bacteria, secreted from the targeted bacteria or expressed on the surface of the targeted bacteria. In a more particular embodiment, an antigen is expressed on the surface of the targeted bacteria for prophylactic and/or therapeutic vaccination.

The present disclosure also relates to a non-therapeutic use of the bacterial delivery particles. For instance, the non-therapeutic use can be a cosmetic use or a use for improving the well-being of a subject, in particular a subject who does not suffer from a disease. Accordingly, the present disclosure also relates to a cosmetic composition or a non-therapeutic composition comprising the bacterial delivery particles if the disclosure.

Example 1

The example below demonstrates that a significative portion of a lambda receptor binding protein (RBP), e.g. the stf protein, can be exchanged with a portion of a different RBP. More particularly, specific fusion positions in the lambda RBP have been identified which allow one to obtain a functional chimeric RBP. Specifically, the data demonstrate, in a non-limiting embodiment, that in the case of phagemids derived from bacteriophage lambda, modifying the side tail fiber protein results in an expanded host range. The addition of chimeric stf proteins to lambdoid phagemids, is demonstrated to be a very powerful approach to modify and increase their host range, and in some cases is more efficient than the modification of the gpJ gene. In addition, modification of the side tail fiber protein to encode depolymerase activities can dramatically increase the delivery efficiency. In some cases, the addition of this enzymatic activity allows for 100% delivery efficiency while the wild-type lambda phagemid showed no entry at all. These two approaches can be combined to generate phagemid variants with different specificities and delivery efficiencies to many strains of bacterial species.

Tests were conducted to determine whether the modification of the tail tip gene (gpJ) would have an impact in the host range of lambda phagemids. The lambda tail tip was modified to include the mutations described in [11] to generate OMPF-lambda. This phagemid should now use OmpF instead of LamB as a primary receptor in the cell surface. Next, the delivery efficiency was tested in a collection of *E. coli* strains that spans a variety of O and K serotypes, as shown in FIG. 1.

As can be seen in FIG. 1, using phagemids that recognize a different cell surface receptor has a minimal impact on efficiency delivery and host range. Only 3 strains show a marginal improvement in the number of colonies after treatment with the modified phagemid. This result may be due to the presence of a capsule around the majority of the cells that forms a physical barrier to the phagemids, thus rendering this approach unsuccessful. In view of these results, the lambda stf gene was modified to include enzymatic activities against bacterial capsules.

The sequence of lambda stf (SEQ ID NO: 1) is:

MAVKISGVLKDGTGKPVQNCTIQLKARRNSTTVVVNTVGSENPDEAGRY

SMDVEYGQYSVILQVDGFPPSHAGTITVYEDSQPGTLNDFLCAMTEDDA

RPEVLRRLELMVEEVARNASVVAQSTADAKKSAGDASASAAQVAALVTD

ATDSARAASTSAGQAASSAQEASSGAEAASAKATEAEKSAAAAESSKNA

AATSAGAAKTSETNAAASQQSAATSASTAATKASEAATSARDAVASKEA

AKSSETNASSSAGRAASSATAAENSARAAKTSETNARSSETAAERSASA

AADAKTAAAGSASTASTKATEAAGSAVSASQSKSAAEAAAIRAKNSAKR

AEDIASAVALEDADTTRKGIVQLSSATNSTSETLAATPKAVKVVMDETN

RKAPLDSPALTGTPTAPTALRGTNNTQIANTAFVLAAIADVIDASPDAL

NTLNELAAALGNDPDFATTMTNALAGKQPKNATLTALAGLSTAKNKLPY

FAENDAASLTELTQVGRDILAKNSVADVLEYLGAGENSAFPAGAPIPWP

SDIVPSGYVLMQGQAFDKSAYPKLAVAYPSGVLPDMRGWTIKGKPASGR

AVLSQEQDGIKSHTHSASASGTDLGTKTTSSFDYGTKTTGSFDYGTKST

NNTGAHAHSLSGSTGAAGAHAHTSGLRMNSSGWSQYGTATITGSLSTVK

GTSTQGIAYLSKTDSQGSHSHSLSGTAVSAGAHAHTVGIGAHQHPVVIG

AHAHSFSIGSHGHTITVNAAGNAENTVKNIAFNYIVRLA

The bold and underlined sequence represents the part of the protein that was introduced in the T4 phage [47]. Experiments were conducted to investigate if it was possible to exchange the C-terminus of the lambda stf with a tail fiber from a different phage to yield chimeric side tail fibers with an enzymatic activity against encapsulated *E. coli*. The tail fiber from the K1F phage which has been studied in depth and its structure solved [19], [20] was chosen. K1F encodes an enzyme with endosialidase activity, which is active against polymer of sialic acid secreted by K1-encapsulated *E. coli*. In fact, K1+ strains are immune to T7 infection because the capsule forms a physical barrier that prevents attachment of the phage, but if purified K1F enzyme is added to the cells before infection, T7 is able to lyse them [21], confirming that the presence of bacterial capsules is a powerful mechanism to avoid recognition by bacteriophages. Thus, by testing delivery of modified lambda-stf-K1 phagemids in K1+ strains it was possible to verify whether the lambda-stf chimeric proteins retain its enzymatic activity.

The sequence of K1F tail fiber (SEQ ID NO: 121) is:

MSTITQFPSGNTQYRIEFDYLARTFVVVTLVNSSNPTLNRVLEVGRDYR

ELNPTMIEMLVDQSGEDIVRIHRQTGTDLVVDERNGSVLTASDLTTAEL

QAIHIAEEGRDQTVDLAKEYADAAGSSAGNAKDSEDEARRIAESIRAAG

-continued

LIGYMTRRSFEKGYNVTTWSEVLLWEEDGDYYRWDGTLPKNVPAGSTPE

TSGGIGLGAWVSVGDAALRSQISNPEGAILYPELHRARWLDEKDARGWG

AKGDGVTDDTAALTSALNDTPVGQKINGNGKTYKVTSLPDISRFINTRF

VYERIPGQPLYYASEEFVQGELFKITDTPYYNAWPQDKAFVYENVIYAP

YMGSDRHGVSRLHVSWVKSGDDGQTWSTPEWLTDLHPDYPTVNYHCMSM

GVCRNRLFAMIETRTLAKNALTNCALWDRPMSRSLHLTGGITKAANQRY

ATIHVPDHGLFVGDFVNFSNSAVTGVSGDMTVATVIDKDNFTVLTPNQQ

TSDLNNAGKNWHMGTSFHKSPWRKTDLGLIPSVTEVHSFATIDNNGFAM

GYHQGDVAPREVGLFVFPDAFNSPSNYVRRQIPSEYEPDASEPCIKYYD

GVLYLITRGTRGDRLGSSLHRSRDIGQTWESLRFPHNVHHTTLPFAKVG

DDLIMFGSERAENEWEAGAPDDRYKASYPRTFYARLNVNNWNADDIEWV

NITDQIYQGGIVNSGVGVGSVVVKDNYIYYMFGGEDHFNPWTYGDNSAK

DPFKSDGHPSDLYCYKMKIGPDNRVSRDFRYGAVPNRAVPVFFDTNGVR

TVPAPMEFTGDLGLGHVTIRASTSSNIRSEVLMEGEYGFIGKSIPTDNP

AGQRIIFCGGEGTSSTTGAQITLYGANNTDSRRIVYNGDEHLFQSADVK

PYNDNVTALGGPSNRFTTAYLGSNPIVTSNGERKTEPVVFDDAFLDAWG

DVHYIMYQWLDAVQLKGNDARIHFGVIAQQIRDVFIAHGLMDENSTNCR

YAVLCYDKYPRMTDTVFSHNEIVEHTDEEGNVTTTEEPVYTEVVIHEEG

EEWGVRPDGIFFAEAAYQRRKLERIEARLSALEQK

The bold and underlined sequence represents the part of the protein that has been crystalized and has been shown to retain its endosialidase activity. Since there is no identity between the lambda stf protein and the K1F tail fiber, the insertion point was made based on conclusions extracted from different sources of information, including literature and crystal structures.

Figures 1, 12:
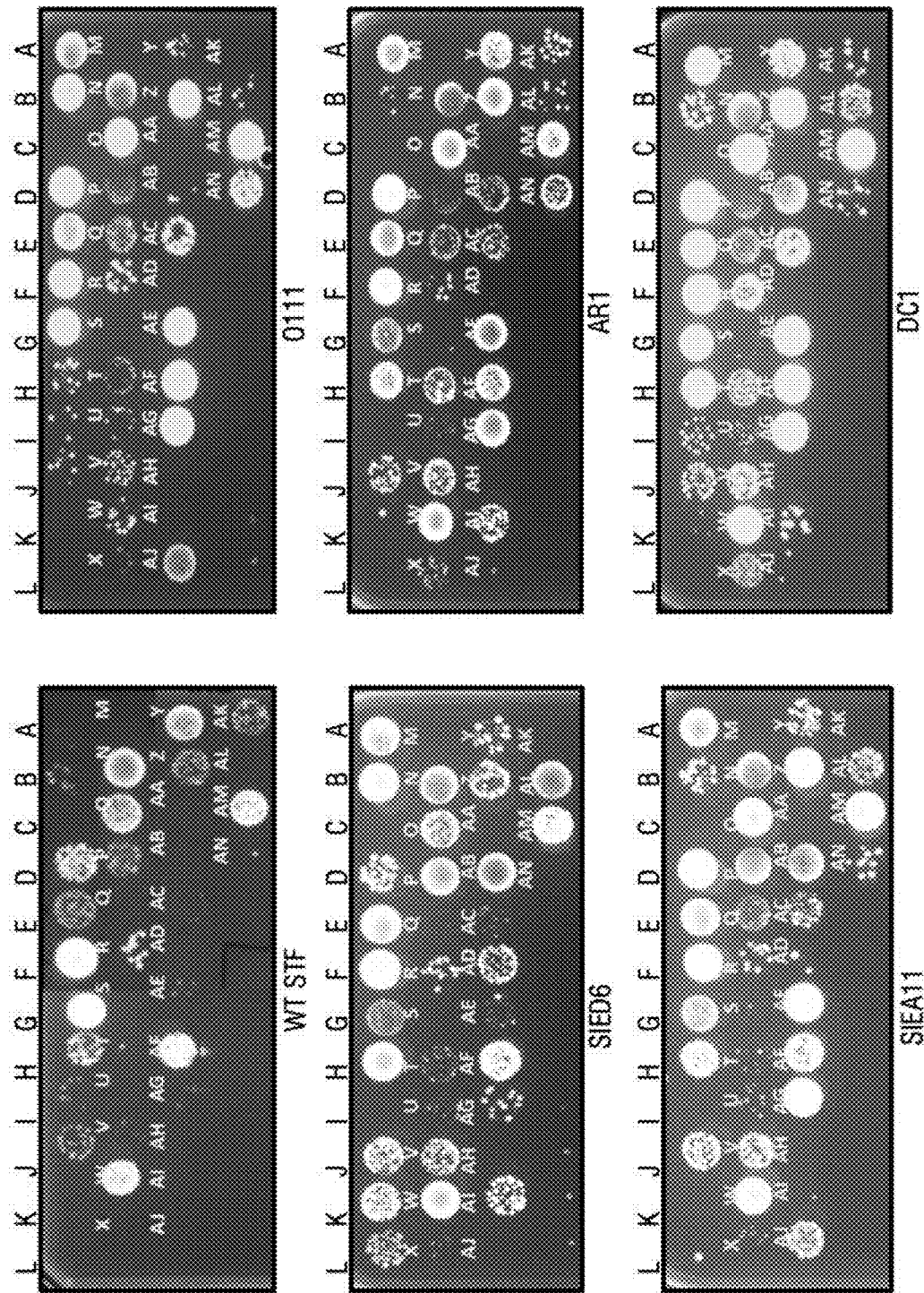
Figures 2, 12:
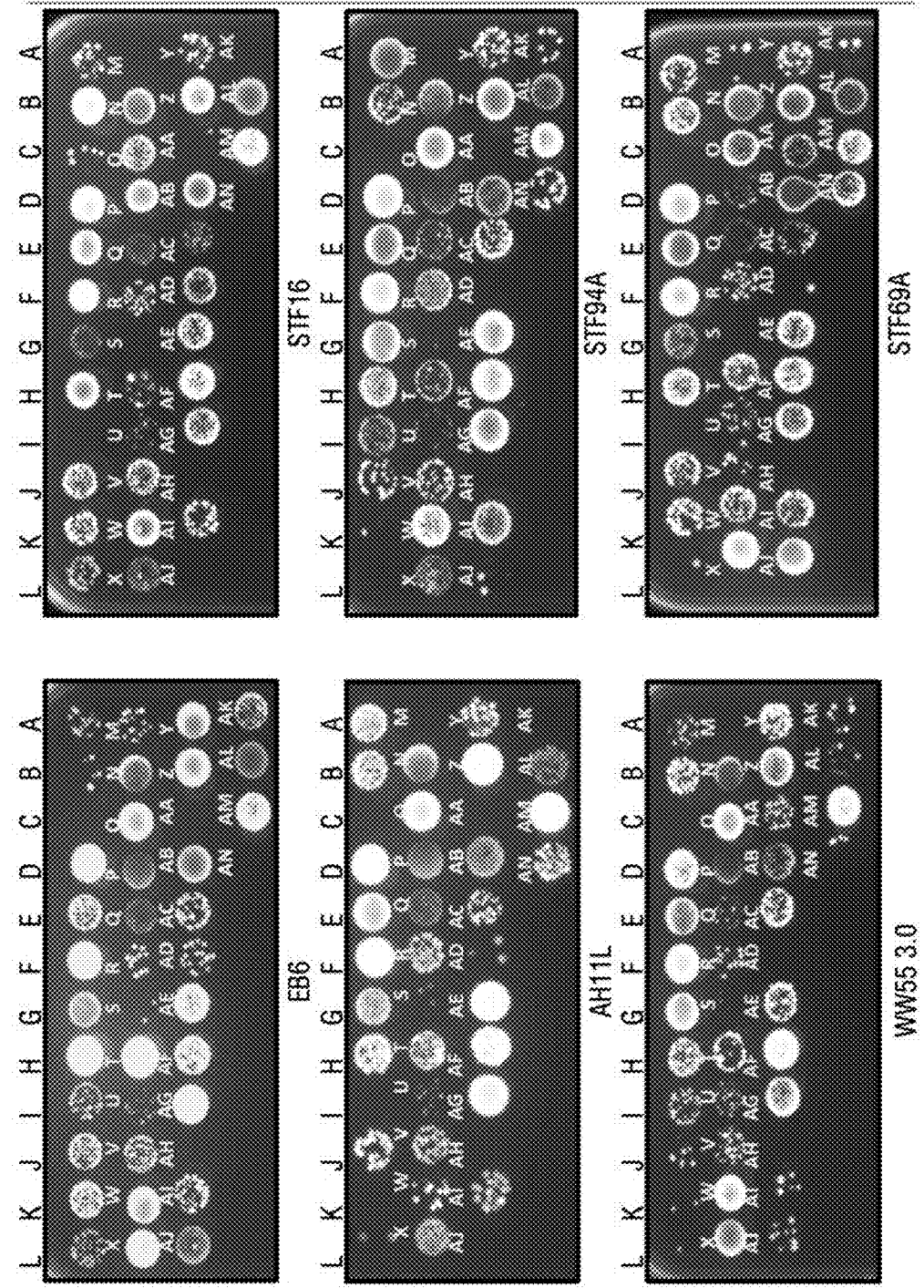
Figures 3, 12:
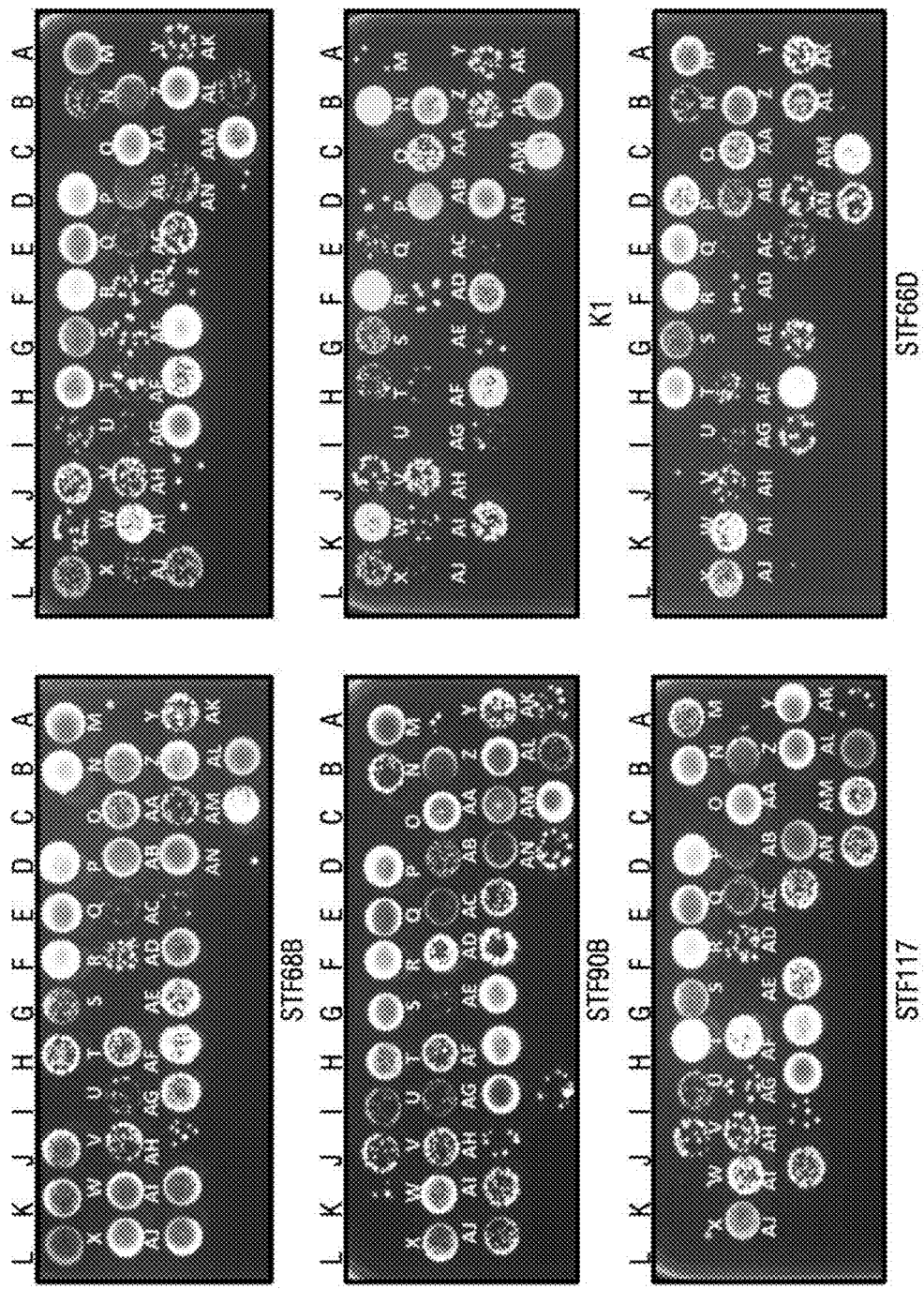

The stf gene was modified to include the K1F endosialidase at its C-terminus using a Cas9-mediated gene exchange protocol [22]. lambda-K1F phagemids were produced as in [23] and titrated against some K1+ strains, specifically *E. coli* UTI89 and S88. The results were striking; in these strains, there is no delivery if lambda wild-type stf is used, but the addition of the K1F variant gives 100% delivery (FIG. 2).

Figure 3:
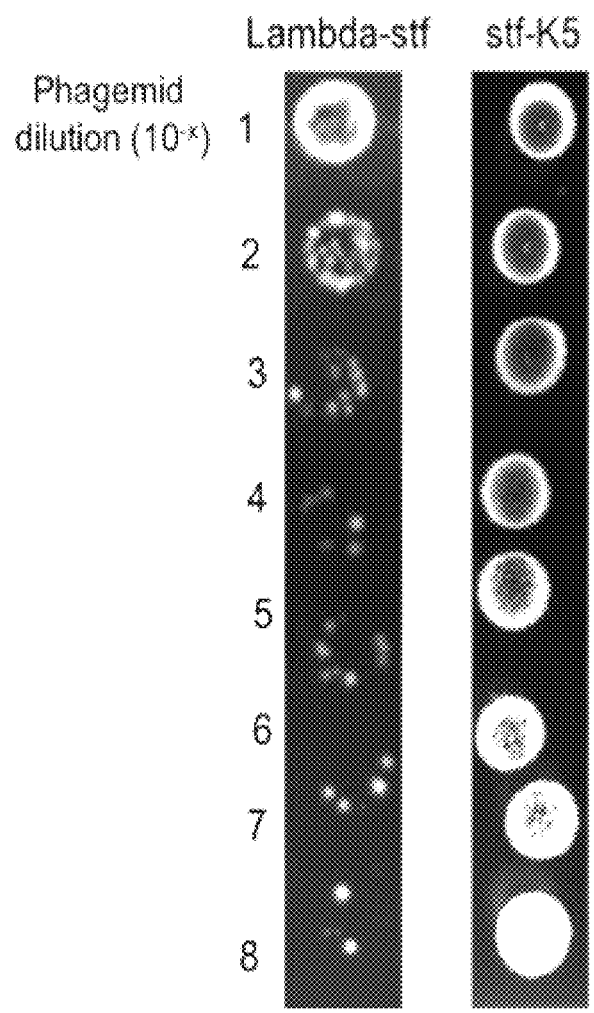
FIG. 3 depicts wild-type lambda and lambda-stf-K5 chimeric delivery vehicles on a K5+ strain. Lambda packaged phagemids were sequentially diluted 10× in LB plus 5 mM CaCl2 and 10 uL added in each well. ECOR55 grown to an OD600 of around 0.5 were then added to each phagemid dilution, incubated for 30 min at 37° C. and 10 uL plated on LB supplemented with chloramphenicol. Left panel, wild type lambda packaged phagemids; right panel, stf-K15 lambda packaged phagemids.

The same principle was followed to create a different variant of lambda-stf, this time with K5-capsule degrading activity (K5 lyase tail fiber from phage K5A). As in the case of K1F, there is no homology between lambda-stf and K5 lyase, but its crystal structure has been published [24]. Hence, the same approach as for K1F was used to generate stf-K5 chimeric side tail fibers and tested the produced phagemids against a K5-encapsulated strain of *E. coli* (ECOR 55). In this case, however, a delta-stf lambda production strain was produced with the stf fusion gene expressed in trans under the control of an inducible promoter. As depicted in FIG. 3, there was some residual delivery using the wild-type lambda-stf, probably due to the presence of some cells with a thinner K5 capsule. However, the addition of lambda-stf-K5 chimeras allows for an improvement in delivery of more than $10^6$ fold.

In some other cases, side tail fibers can be found that have some degree of homology to lambda stf, although no crystal structure is available. In these cases, the insertion point was designed as the last stretch of amino acids with identity to lambda stf. For example, in two in-house sequenced phages, the predicted side tail fiber proteins are as follows:

Phage AG22 stf (SEQ ID NO: 262)
MAIYRQGQASMDAQGYVTGYGTKWREQLTLIRPGATIFFLAQPLQAAVI

TEVISDTSIRAITTGGAVVQKTNYLILLHDSLTVDGLAQDVAETLRYYQ

GKESEFAGFIEIIKDFDWDKLQKIQEDVKTNADAAAASQQAAKTSENNA

KTSATNAANSKKGADTAKAAAESARDAANTAKTGAEAAKSGAESARDAA

NTAKAGAESARDQAEEYAKQAAEPYKDLLQPLPDVWIPFNDSLDMITGF

SPSYKKIVIGDDEITMPGDKIVKFKRASTATYINKSGVLTNAAIDEPRF

EKDGLLIEGQRTNLLINSTNPSKWNKSSNMILDRSGVDDFGFQYAKFTL

KPEMVGQTSSINIVTVSGSRGFDVTGNEKYVTISCRAQSGTPNLRCRLR

FENYDGSAYASLGDAYVNLTDLSIEKTGGAANRITARAVKDEASKWIFF

EATIKALDTENMIGAMVQYAPAKDGGGTGADDYIYIATPQVEGGVCASS

FIITEATPVTRASDMVTIPIKNNLYNLPFTVLCEVHKNWYITPNAAPRV

FDTGGHQSGAAIILAFGSADGDNDGFPYCDIGKSNRRVNENAKLKKMII

GMRVKSDYNTCCVSNARISSETKTEWRYIVSTATIRIGGQTSTGERHLF

GHVRNFRIWHKALTDHQLGEIV

Its alignment to lambda stf is as follows:

```
Lambda  156   ATASGQAASSAQEASSGAEAASAKATEAEKSAAAAESSJNAAATSAGAAETSETNAAASQ
AG22     92   ETLRYYQGKESEPAGFIEIIKDFDWDKLQKIQEDVKTNADAAAASQQAAKTSENNAKTSA
                *            *              *         *** *  ****** **   *
```

The sequence of the stf of a second in-house phage is as follows:

Phage SIEA11 stf (SEQ ID NO: 263)
MSTKFKTVITTAGAAKLAAATVPGGKKVTLSAMAVGDGNGKLPVPDAGQ

TKLVHEVWRHALNKVSVDNKNKNYIVAELVVPPEVGGFWMRELGLYDDA

GTLIAVSNMAESYKPELAEGSGRAQTCRMVIIVSNVASVELSIDASTVM

ATQDYVDDKIAEHEQSRRHPDATLTEKGFTQLSSATNSTSESLAATPKA

VKAANDNANSRLAKNQNGADIQDKSAFLDNVGVTSLTFMKNNGEMPVDA

DLNTFGSVKAYSGIWSKATSTNATLEKNFPEDNAVGVLEVFTGGNFAGT

QRYTTRDGNLYIRKLIGTWNGNDGPWGAWRHVQAVTRALSTTIDLNSLG

GAEHLGLWRNSSSAIASFERHYPEQGGDAQGILEIFEGGLYGRTQRYTT

RNGTMYIRGLTAKWDAENPQWEDWNQIGYQTSSTFYEDDLDDLMSPGIY

SVTGKATHTPIQGQSGFLEVIRRKDGVYVLQRYTTTGTSAATKDRLYER

VFLGGSFNAWGEWRQIYNSNSLPLELGIGGAVAKLTSLDWQTYDFVPGS

LITVRLDNMTNIPDGMDWGVIDGNLINTSVGPSDDSGSGRSMHVWRSTV

SKANYRFFMVRISGNPGSRTITTRRVPIIDEAQTWGAKQTFSAGLSGEL

SGNAATATKLKTARKINNVSFDGTSDINLTPKNIGAFASGKTGDTVAND

KAVGWNWSSGAYNATIGGASTLILHFNIGEGSCPAAQFRVNYKNGGIFY

RSARDGYGFEADWSEFYTTTRKPTAGDVGALPLSGGQLNGALGIGTSSA

LGGNSIVLGDNDTGFKQNGDGNLDVYANSVHVMRFVSGSVQSNKTINIT

GRVNPSDYGNFDSRYVRDVRLGTRVVQTMQKGVMYEKAGHVITGLGIVG

EVDGDDPAVFRPIQKYINGTWYNVAQV

Its alignment to lambda stf is as follows:

```
Lambda   367    SSATNSTSSTLAATPEAVKVVMDETNRKAPLDSPALTGTPTAPTALRGTNNTQIANTAPV
SIEA11   180    SSATNSTSESLAATPKAVKAANDNANSRL---AKNQNGADIQDKSAF-LDNVGVTSLTFM
                *********  *********   *   *              *          *       *
```

In these two specific cases, it was unknown which antigen these side tail fibers were able to recognize, so lambda packaged phagemids with the chimeric side tail fibers were produced and their delivery efficiency was tested in a *E. coli* collection that contains a very diverse group of O and K serotypes.

Figure 4:
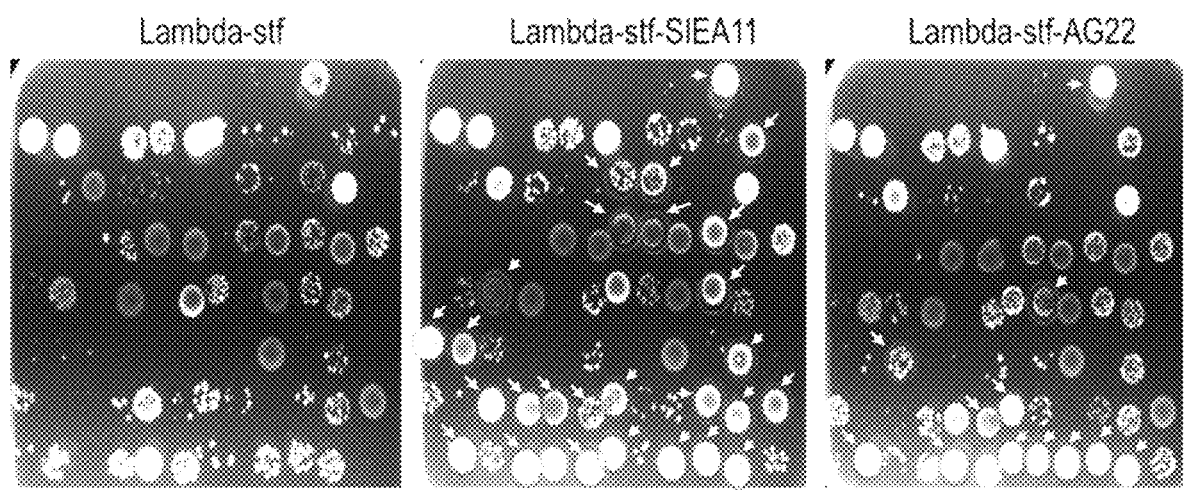
FIG. 4 depicts wild-type lambda, lambda-stf-AG22 and lambda-stf-SIEA11 chimeric delivery vehicles on a variety of encapsulated strains (O and K capsules). Lambda phagemids were diluted 1:5 in LB plus 5 mM CaCl2 and 10 uL added in each well. 90 uL of cells grown to an OD600 of around 0.5 were then added to each phagemid-containing well, incubated for 30 min at 37° C. and 10 uL spotted on LB-agar supplemented with chloramphenicol. Left panel, wild type lambda phagemids; middle panel, lambda stf-SIEA11 variant; right panel, lambda-stf-AG22 variant. Arrows show strains with modified delivery as compared to lambda wild-type.

As shown in FIG. 4, the addition of a chimeric stf allows the lambda-based phagemid to show increased delivery efficiency in 25 out of 96 strains tested (more than 25% of the collection). In some cases, the increase is modest; in others, it allows for very good delivery efficiency in strains that had no or very low entry with wild-type lambda phagemids. It is also worth noting that AG22 belongs to the Siphovirus family, like lambda, but SIEA11 is a P2-like phage. This highlights the significant observation that stf modules can be exchanged across bacteriophage genera.

Other side tail fiber genes have been analyzed as shown in FIG. 4 and several insertion points into the lambda stf gene have been identified that give chimeric variants with differential entry in the *E. coli* collection as shown previously. These insertion points are based on the results for the non-homologous tail fiber variants (such as in the cases for K1F and K5 above) or on varying degrees of homology between lambda stf and the variant to be tested. This homology can be short, about 5-10 aminoacids, or substantially similar. The insertion points tested are shown in bold and underlined below:

Lambda stf
(SEQ ID NO: 1)
MAVKISGVLKDGTGKPVQNCTIQLKARRNSTTVVVNTVGSENPDEAGRY

SMDVEYGQYSVILQVDGFPPSHAGTITVYEDSQPGTLNDFLCAMTEDDA

RPEVLRRLELMVEEVARNASVVAQSTADAKKSAGDASASAAQVAALVTD

ATDSARAASTSAGQAASSAQEASSGAEAASAKATEAEKSAAAAESSKNA

AATSAGAAKTSETNAAASQQSAATSASTAATKASEAATSARDAVASKEA

AKSSETNASSSAGRAASSATAAENSARAAKTSETNARSSETAAERSASA

AADAKTAAAGSASTASTKATEAAGSAVSASQSKSAAEAAAIRAKNSAKR

AEDIASAVALEDADTTRKGIVQLSSATNSTSETLAATPKAVKVVMDETN

RKAPLDSPALTGTPTAPTALRGTNNTQIANTAFVLAAIADVIDASPDAL

NTLNELAAALGNDPDFATTMTNALAGKQPKNATLTALAGLSTAKNKLPY

FAENDAASLTELTQVGRDILAKNSVADVLEYLGAGENSAFPAGAPIPWP

SDIVPSGYVLMQGQAFDKSAYPKLAVAYPSGVLPDMRGWTIKGKPASGR

AVLSQEQDGIKSHTHSASASGTDLGTKTTSSFDYGTKTTGSFDYGTKST

NNTGAHAHSLSGSTGAAGAHAHTSGLRMNSSGWSQYGTATITGSLSTVK

GTSTQGIAYLSKTDSQGSHSHSLSGTAVSAGAHAHTVGIGAHQHPVVIG

AHAHSFSIGSHGHTITVNAAGNAENTVKNIAFNYIVRLA

Figure 5:
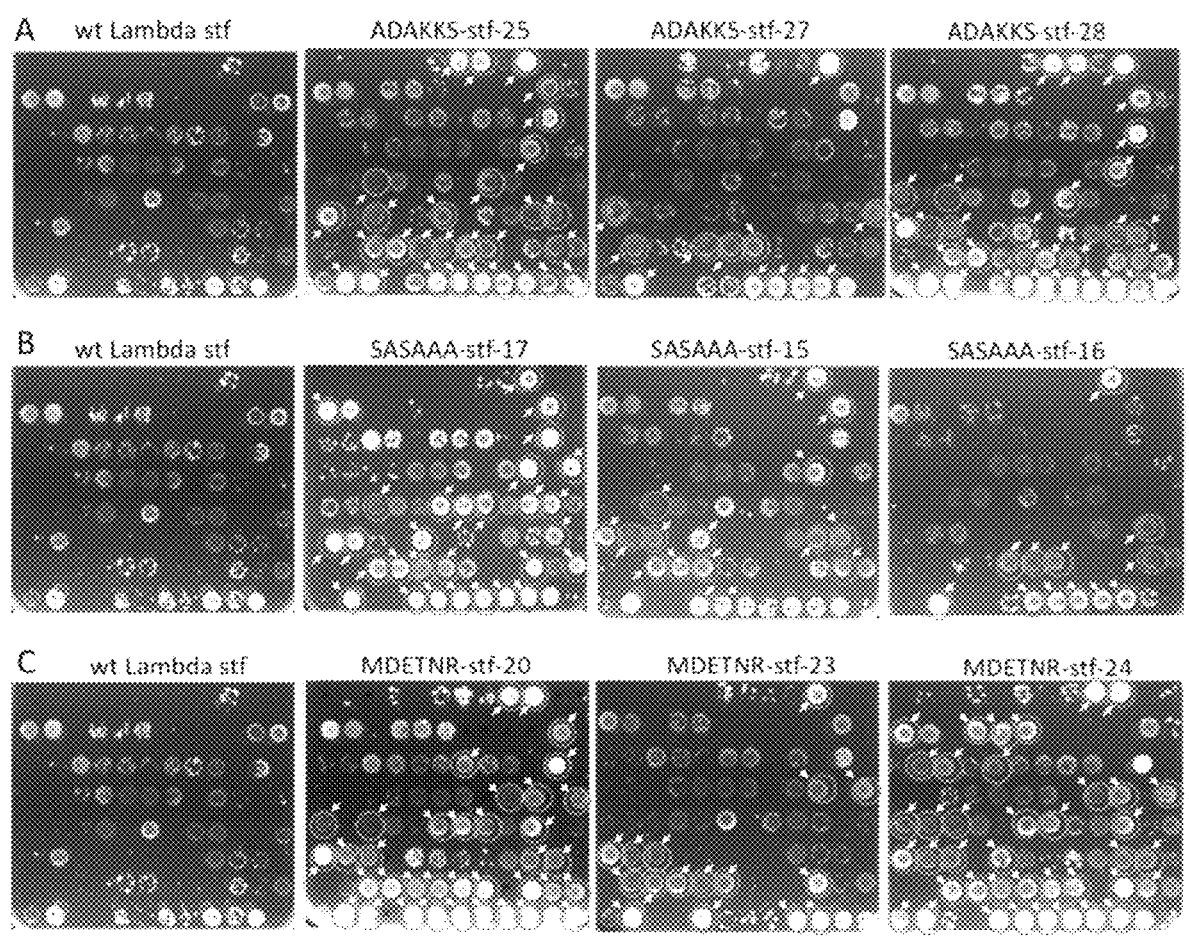
FIG. 5A-C demonstrates delivery of wild-type lambda and stf chimeras with different insertion sites on a variety of encapsulated strains (O and K capsules). Lambda packaged phagemids were diluted 1:5 in LB plus 5 mM CaCl2 and 10 uL added in each well. 90 uL of cells grown to an OD600 of around 0.5 were then added to each phagemid-containing well, incubated for 30 min at 37° C. and 10 uL spotted on LB-agar supplemented with chloramphenicol.

The lambda stf protein consists of 774 aminoacids. The insertion points can be found closer to the N-terminus (amino acid 131, insertion point ADAKKS (SEQ ID NO: 249)) or closer to the C-terminus (amino acid 529, insertion point GAGENS (SEQ ID NO: 252)). FIG. 5 depicts some selected examples for the insertion points ADAKKS (SEQ ID NO: 249), SASAAA (SEQ ID NO: 251) and MDETNR (SEQ ID NO: 250).

Figure 6:
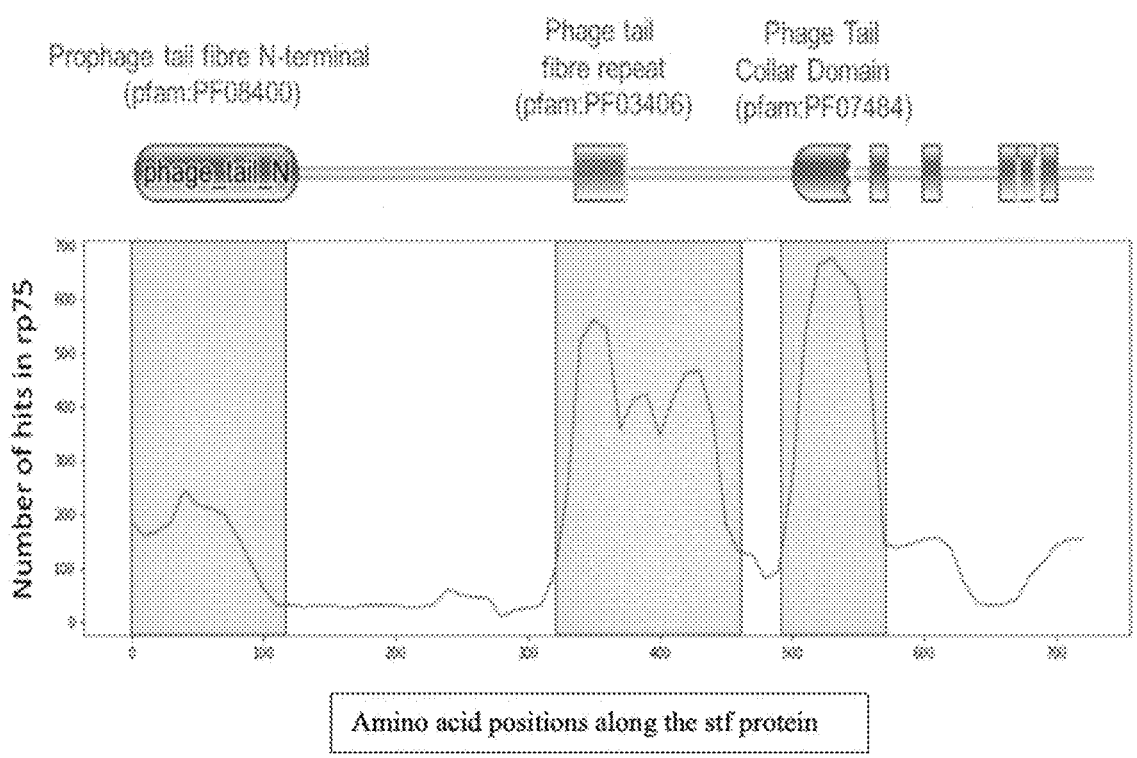
FIG. 6 depicts a phmmer search that was performed with a 50aa sliding window (step 10) on the representative proteome database (rp75). The number of significant hits (E-value<0.01) is reported.

The results described herein show that it is possible to build chimeric tail fibers that combine the part of one tail fiber that attaches to the capsid of one phage (usually the N-terminus of the protein) with the part of another fiber that interacts with the bacterium (usually the C-terminus of the protein). Stretches of homology between the sequence of different tail fibers can be considered as preferable recombination points. In order to identify such points for the stf protein of phage lambda a scan of the stf sequence was performed with a 50aa window and a phmmer search [25] was performed on each window to identify homologous sequences in the representative proteome 75 database (FIG. 6).

Example 2

T4-like phages are a very diverse family of bacteriophages that share a common long tail fiber architecture: a proximal tail fiber that attaches to the phage particle and a distal tail fiber (DTF) that encodes host specificity linked by proteins acting as "hinge connectors" (Desplats and Krisch, 2003, Res. Microbiol. 154:259-267; Bartual et al. 2010, Proc. Natl. Acad. Sci. 107: 20287-20292). It is thought that the main host range determinants of the tail fiber reside in the distal part. Hence, it is very important to understand if it is possible to translate the host range of a given T4-like phage, which are known to be very broad, to any other phage or phagemid of interest. The distal tail fiber (C-terminal domain of the T4-like long tail fiber) of several T4-like phages were screened for possible functional insertion sites, several fusions with the Lambda stf gene were generated and their host range screened.

Possible insertion sites in the DTF that, when fused to a heterologous tail fiber (the lambda phage stf), will give a functional chimera were searched. The DTF of the phage (WW13) was used as a testbed. This phage possesses a classical T4-like architecture, with a proximal and a distal tail fiber separated by hinge connectors, a gp38 chaperone/adhesin (to assist folding of the tail fiber and recognition of the host (Trojet et al., 2011, Genome Biol. Evol. 3:674-686) and a gp57A chaperone known to be needed for proper folding of the tail fiber (Matsui et al., 1997, J. Bacteriol.

Figure 7:
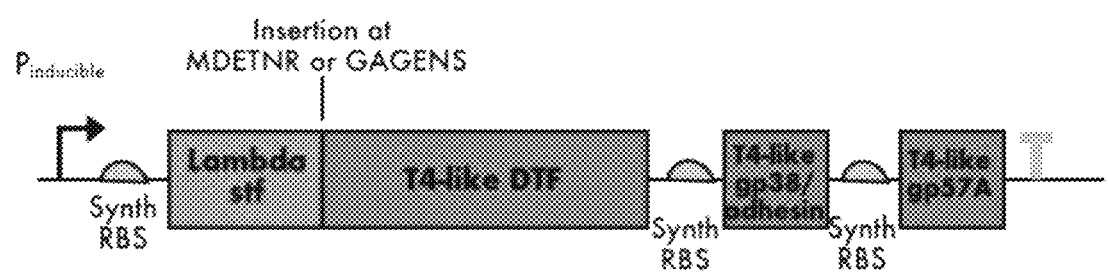
FIG. 7. depicts architecture of the engineered lambda stf-T4-like DTF chimera. The semicircles denote RBS sites; the T sign, a transcriptional terminator; the arrow, a promoter.

179:1846-1851). Since the endogenous genomic regulation of T4-like phages is complex and may include unknown layers of regulation (Miller et al., 2003, Microbio. Mol. Biol. Rev. 67:86-156), a synthetic linker encoding a RBS was designed to replace the natural DNA linker between the DTF gene and the adhesin; immediately downstream, another synthetic RBS preceding the chaperone gp57A was added, hence creating a polycistronic mRNA encoding for all the functions needed for the proper folding of the DTF (FIG. 7). This construct was built in a plasmid under the control of an inducible promoter and complemented in trans in a strain producing lambda-based phagemids.

FIG. 7. depicts the architecture of an engineered lambda stf-T4-like DTF chimera. The semicircles denote RBS sites; the T sign, a transcriptional terminator; the arrow, a promoter. Several parts of the C-terminus of the DTF were screened and fused to the lambda stf gene at the GAGENS (SEQ ID NO: 252) insertion site. Several variants of the chimera lambda stf-WW13 were functional, as assessed by production of phagemid particles and transduction of a chloramphenicol marker in a collection of E. coli strains. The functional chimeras shown in FIG. 8 were obtained with fusion at the IIQLED (SEQ ID NO: 254) insertion site in WW13.

Figure 8:
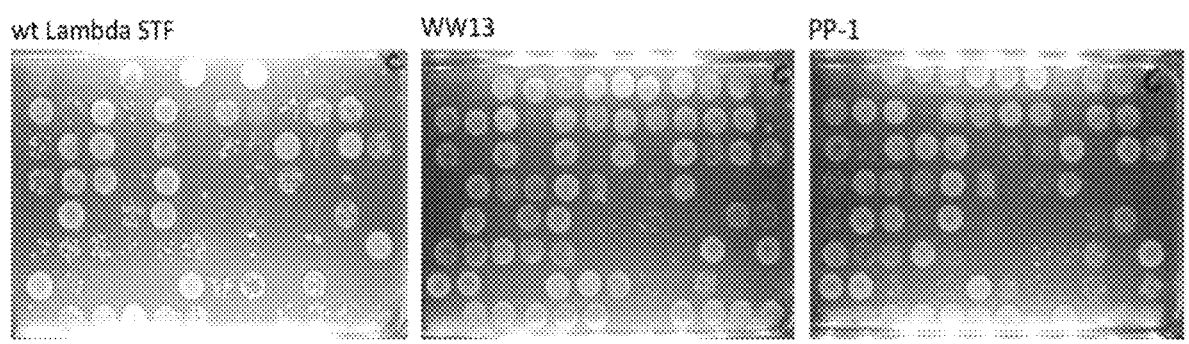
FIG. 8. shows screening of phagemid particles with chimeric lambda stf-T4-like DTFs. A collection of 96 different wild type *E. coli* strains, encompassing different serotypes, was transduced with lambda-based phagemids and plated on Cm LB agar. Left panel, wild-type lambda stf; middle panel, chimeric lambda-stf-WW13; right panel, chimeric lambda-stf-PP-1.
Figure 11:
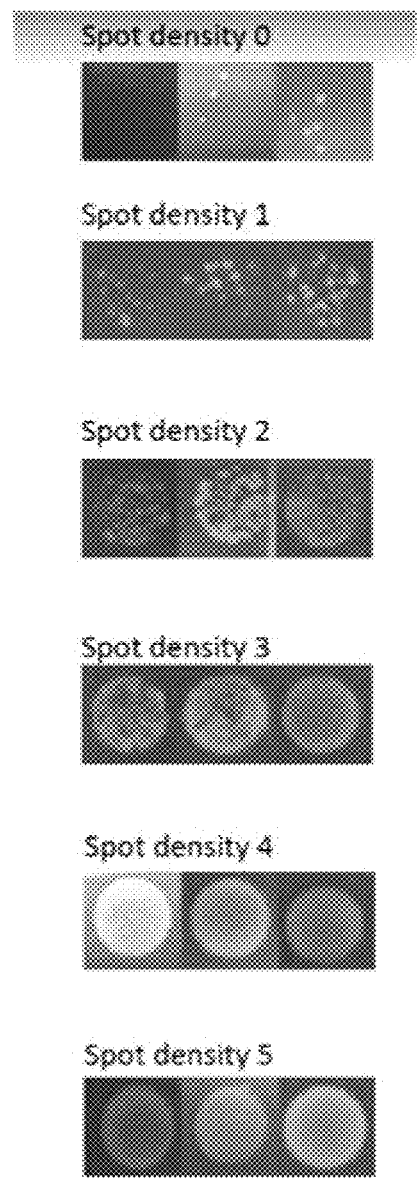
FIG. 11. depicts dot scoring system to quantify delivery efficiency. Density 0, 5 or fewer colonies; density 1, more than 5 colonies but not enough to define a clear circular drop; density 2, several colonies, but the background is clearly visible and some colonies are still separated; density 3, many colonies, the background is still visible but the colonies are hardly discernible as separate; density 4, spot almost completely dense, the background can only be seen faintly in some parts of the drop; density 5, spot looks completely dense, background cannot be seen.

Additional functional chimeras were obtained by fusion at the lambda stf MDETNR (SEQ ID NO: 250) insertion site and at the WW13 DTF GNIIDL (SEQ ID NO: 255), VDRAV (SEQ ID NO: 261) and IIQLED (SEQ ID NO: 254) insertion sites (FIG. 11). Other T4-like phages, like PP-1, sharing sequence homology with WW13 were also tested and verified to produce functional chimeras (FIG. 8). These functional chimeras show a IATRV insertion site at the beginning of PP-1 DTF part.

FIG. 8 depicts screening of phagemid particles with chimeric lambda stf-T4-like DTFs. A collection of 96 different wild type E. coli strains, encompassing different serotypes, was transduced with lambda-based phagemids and plated on Cm LB agar. Left panel represents wild-type lambda stf; the middle panel represents chimeric lambda-stf-WW13; and the right panel, represents chimeric lambda-stf-PP-1.

The insertion sites found for WW13 do not always exist in a given T4-like DTF, thereby complicating the analysis. Another functional insertion site without homology to WW13 was discovered for a second phage (WW55, FIG. 9). The same TPGEL insertion site could be found in a subset of T4-like phages and proven to yield functional chimeras with at least one of them, WW34 (FIG. 9), and at MDETNR (SEQ ID NO: 250) insertion site in lambda stf.

Figure 9:
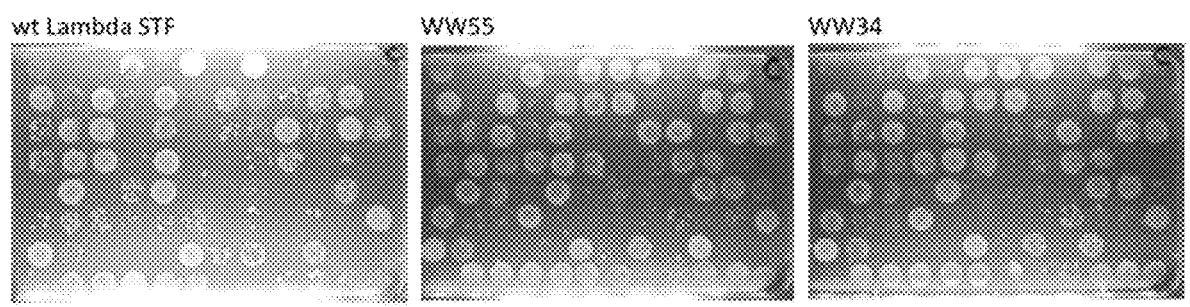
FIG. 9. demonstrates screening of phagemid particles with chimeric lambda stf-T4-like DTFs. A collection of 96 different wild type *E. coli* strains, encompassing different serotypes, was transduced with lambda-based phagemids and plated on Cm LB agar. Left panel, wild-type lambda stf; middle panel, chimeric lambda-stf-WW55; right panel, chimeric lambda-stf-WW34.

FIG. 9. shows screening of phagemid particles with chimeric lambda stf-T4-like DTFs. A collection of 96 different wild type E. coli strains, encompassing different serotypes, was transduced with lambda-based phagemids and plated on Cm LB agar. The left panel represents wild-type lambda stf; the middle panel represents chimeric lambda-stf-WW55; and the right panel represents chimeric lambda-stf-WW34.

Since T4-like DTF proteins may or may not share common sites for insertion, attempts were made to identify a universal insertion site that exists in all T4-like DTFs. When several T4-like DTFs are aligned, no homology along the whole DTF gene present in all the sequences exists, except for the N-terminus which is well conserved. The N-terminus of the DTF is thought to interact with the hinge connectors for attachment to the main phage particle.

Figure 10:
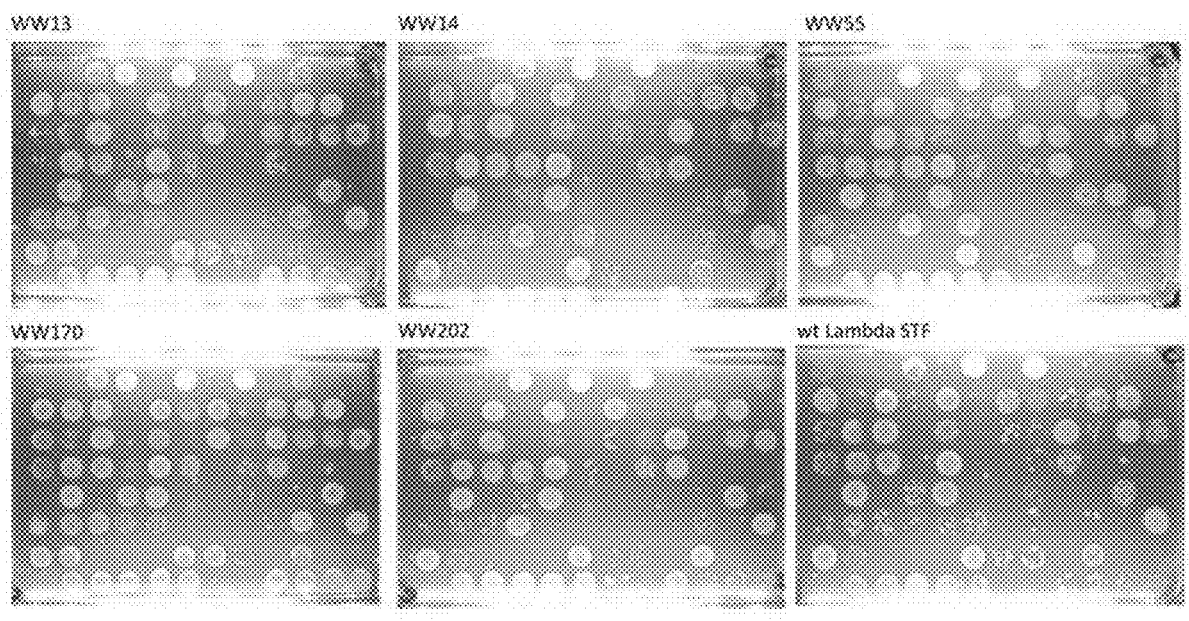
FIG. 10. depicts screening of phagemid particles with chimeric lambda stf-T4-like DTFs. All points shown refer to the universal insertion site of the DTF, located within aminoacid range from position 1 to 90 with reference to WW13 aminoacid sequence. A collection of 96 different wild type *E. coli* strains, encompassing different serotypes, was transduced with lambda-based phagemids and plated on Cm LB agar (names on top).

Although the classic view is that the host range determinants reside in the C-terminal part of the DTF, recent studies have proven that the N-terminus may also be involved in this process (Chen et al., 2017, Appl. Environ. Microbiol. V1. 83 No. 23). The N-terminus of the DTF was then scanned to look for an insertion site that exists in all T4-like phages and that is able to yield functional chimeras. Phage WW13 DTF and insertion site MDETNR (SEQ ID NO: 250) in lambda stf were used. While the direct fusion of the complete DTF gene (starting at amino acid 2) gives particles with some activity, a region from amino acid 1 to 90, with a preferred region from amino acid 40 to 50 of the DTF, that recapitulates the behavior of the DTF fusion was identified and is shown in FIG. 10. Importantly, this region exists in all T4-like phages screened and could be very rapidly used to generate chimeras with a diverse set of DTFs, including WW55 (FIG. 10).

Accordingly, the present disclosure is useful for the generation of phage and phagemid particles with altered host ranges, since it provides a practical framework for the construction of chimeras using the DTFs from any T4-like phage, highlighting its modularity and translatability.

Example 3

The human microbiome comprises different zones of the body, including gut, skin, vagina and mouth [29]. The microbiota in these areas is composed of different communities of microorganisms, such as bacteria, archaea and fungi [29]-[31]. While numerous studies have been made that try to elucidate the specific composition of these communities, it is becoming clear that while there may exist a "core microbiome", there are many variations in the relative content of each microorganism depending on several factors, such as geographical location, diet or age [32]-[35].

Specifically, in the case of the human gut microbiota, it is not possible to know a priori what are the bacterial species that a given person possesses without running a diagnostic method. In the case of Escherichia coli, some studies have been made that point out to the prevalence of some serotypes and phylogenetic groups in the majority of humans; however, there are significant changes in the composition of the samples depending on the geographic distribution as well as the time of sampling: for example, samples isolated from Europe, Africa, Asia and South America in the 1980s show a prevalence for phylogroups A and B1 (55% and 21%, respectively); but samples obtained in the 2000s in Europe, North America, Asia and Australia belong mainly to the B2 group (43%), followed by the A (24%), D (21%), and B1 (12%) [36]. It is also thought that phylogenetic groups B2 and D are usually more commonly associated with pathogenic strains than with commensal strains [37], but there are studies showing a number of human- and non-human-specific strains belonging to phylogenetic group B2 that are commensals and belong to different serotypes [38].

The intrinsic variability of the human microbiome, and specifically that of Escherichia coli subtypes, makes it difficult to design targeted therapeutic approaches. In the case of phage therapy aimed at killing a target bacterial population, for instance, two possible approaches are possible: first, the use of narrow host range particles that are able to recognize and target a specific E. coli serotype or second the use of broad host range phages that are able to recognize many different strains, sometimes even from different genera [39]. This difficulty is exacerbated if one takes into account strategies that do not aim to kill the target bacterial population, but that seek to add a function to them (i.e. delivery of a factor that will have an effect in the host and that will be expressed by the targeted microbiota). In this specific case, the use of packaged phagemids is of great interest, since they do not kill the host (unless their payload carries genes aimed at killing the host), payload does not replicate and expand and does not contain any endogenous phage genes. However, as in the case of phages, a diagnostic study would be needed to identify the specific serotypes/variants of bacteria that exist in the patient before the treatment in order to find or design a packaged phagemid that allows for delivery of a payload adding a function to the target bacteria without killing them.

By combining these two approaches, it was proposed to use engineered delivery vehicles that are able to recognize a large number of strains belonging to different serotypes and phylogenetic groups (i.e., engineered particles having a "broad host range"), with a focus on *Escherichia coli*. As opposed to a killing-oriented approach, where the targeted bacterial population needs to be as close as possible to 100% to reduce their numbers, a therapeutic delivery approach does not need a priori to reach a large percentage of bacteria; the delivery needs to be high enough for the therapeutic payload to be expressed at the correct levels, which may be highly variable depending on the application. Additionally, the payload can be expressed by different serotypes or phylogenetic groups. This approach increases the chance that the particle will deliver a payload expressed in vivo in the majority of patients.

To achieve the delivery in bacterial communities composed of unknown serotypes/variants of target strains, delivery vehicles were engineered to contain chimeric side tail fibers (stf) that have been selected due to their ability to recognize a large variety of target strains. There are many phages that have been described as having a broad host range in *E. coli* and many of these belong to the T4 family, although in general, phages against *E. coli* and related bacteria have a restricted host range.

However, according to [41], there is no consensus as to how many strains need to be targeted by a phage to be considered as a "broad host range".

In the case of *Escherichia coli*, the ECOR collection is a set of strains isolated from different sources that is thought to represent the variability of this bacterium in Nature [42]. Some phage have been shown to have a broad host range against this collection (for instance, about 53% of the ECOR strains can be lysed with phage AR1 [43] and about 60% with phage SU16 [44]). As opposed to this, a single phage is able to infect 95% of *Staphylococcus aureus* strains [40].

It was decided to use human strains of this collection to test engineered delivery vehicles with chimeric stf and assess their host range in an attempt to identify variants that are able to recognize as many hosts as possible, as has been described in the literature [45]. The difference is that the present assays measure delivery efficiency as opposed to lysis.

Strains from an overnight culture were diluted 1:100 in 600 uL of LB supplemented with 5 mM CaCl2 in deep 96 well plates and grown for 2 hours at 37° C. at 900 rpm. 10 uL of packaged phagemids produced at an average of $10^6$/uL were then added to 90 uL of the bacterial cultures, incubated 30 minutes at 37° C. and 10 uL of the mixtures plated on LB agar supplemented with 24 ug/mL chloramphenicol and incubated overnight at 37° C. The next day, the density of the dots was scored from 0 to 5, with 0 being no transductants and 5 being a spot with very high density [FIG. 11]. The density of the spots is directly related to the delivery efficiency of the packaged phagemids, since it corresponds to the number of bacteria that have received a payload containing a chloramphenicol acetyltransferase gene.

Figure 13:
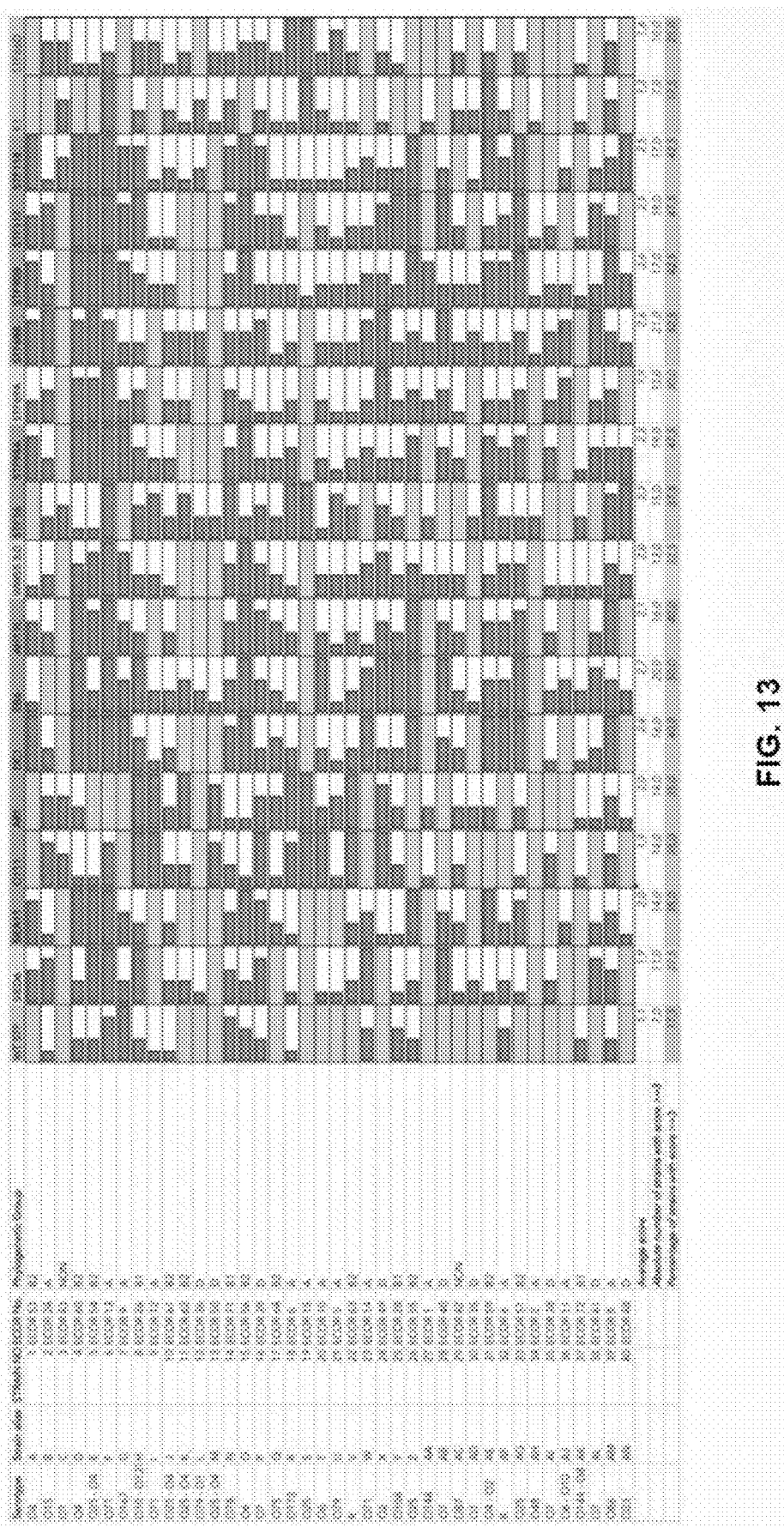

Several stf chimeras were tested and screened in 40 human strains of the ECOR collection. As a control, the delivery efficiency of the wild-type stf was tested. The packaged phagemid variant used for the delivery experiments was modified so that its tail tip gpJ now recognizes a receptor other than LamB (1A2 variant)(SEQ ID NO: 214). In FIG. 12, the raw dot titrations for 18 stf are shown and in FIG. 13 a bar-formatted table is shown with the delivery efficiencies scored by dot density as well as the delivery statistics.

Taking only into account dots with density scores of 3 and higher (considered as medium to high delivery efficiency), some stf's can be considered as broad host range because the delivery efficiency in the selected ECOR strains is significantly higher than when using the wild type stf. For example, for stf EB6 or stf 68B, about 50% of the strains show medium to high delivery efficiencies, as compared to 17.5% of the strains with the wild type stf. These stf are good candidates for in vivo delivery, since they are able to deliver in different phylogenetic groups as well as serotypes. At the bottom of the Table in FIG. 13, a bar-formatted representation for density scores higher than 3 is shown, where the threshold for a broad host range stf is set at an increase of at least 2× compared to the basal line of the wild type stf; this is, stf that are able to deliver with scores of 3 and higher in at least 35% of the strains. Other stf also show an increased delivery as compared to the wild type stf, so a less stringent threshold was set for stf able to deliver with scores 3 or higher with at least a 50% increase compared to the number of strains delivered with the wild-type stf (this is, delivery with scores of 3 and higher in at least 26.25% of the strains). As a comparison, data for stf K1 and stf 66D is shown: these stf seem to be delivering efficiently in a small number of strains (for instance, strains B and AB for stf K1; and strains E and AF for stf 66D), which means that they probably have a narrow host range; this is to be expected, since in the case of the K1 stf the cognate receptor is the K1 capsule [46]. Additionally, data are shown for a chimera with a stf originating in a T4-like phage; as the literature suggests, this chimera shows a broad host range although it does not seem to be the best candidate.

Taken together, these results suggest that the stf of a delivery vehicle can be engineered to recognize a wide number of target *E. coli* strains, hence rendering it "broad host range". This type of particles can be very useful to deliver payloads adding a function to the target bacteria without having to engineer a specific variant that recognizes a given bacterial strain.

List of References Cited Each of the reference cited within the specification and those listed below are hereby incorporated by reference in their entirety.

[1] G. P. C. Salmond and P. C. Fineran, "A century of the phage: past, present and future," Nat. Rev. Microbiol., vol. 13, no. 12, pp. 777-786, December 2015.

[2] P. Hyman and S. T. Abedon, "Bacteriophage host range and bacterial resistance," Adv. Appl. Microbiol., vol. 70, pp. 217-248, 2010.

[3] S. Chatterjee and E. Rothenberg, "Interaction of Bacteriophage λ with Its *E. coli* Receptor, LamB," Viruses, vol. 4, no. 11, pp. 3162-3178, November 2012.

[4] Nobrega et al, Nat Rev, 2018 "Targeting mechanisms of tailed bacteriophages"

[5] A. Flayhan, F. Wien, M. Paternostre, P. Boulanger, and C. Breyton, "New insights into pb5, the receptor binding protein of bacteriophage T5, and its interaction with its *Escherichia coli* receptor FhuA," Biochimie, vol. 94, no. 9, pp. 1982-1989, September 2012.

[5] M. G. Rossmann, V. V. Mesyanzhinov, F. Arisaka, and P. G. Leiman, "The bacteriophage T4 DNA injection machine," Curr. Opin. Struct. Biol., vol. 14, no. 2, pp. 171-180, April 2004.

[6] Y. Zivanovic et al., "Insights into Bacteriophage T5 Structure from Analysis of Its Morphogenesis Genes and Protein Components," J. Virol., vol. 88, no. 2, pp. 1162-1174, January 2014.

[7] R. W. Hendrix and R. L. Duda, "Bacteriophage lambda PaPa: not the mother of all lambda phages," Science, vol. 258, no. 5085, pp. 1145-1148, November 1992.

[8] M. A. Speed, T. Morshead, D. I. Wang, and J. King, "Conformation of P22 tailspike folding and aggregation intermediates probed by monoclonal antibodies," Protein Sci. Publ. Protein Soc., vol. 6, no. 1, pp. 99-108, January 1997.

[9] S. J. Labrie, J. E. Samson, and S. Moineau, "Bacteriophage resistance mechanisms," Nat. Rev. Microbiol., vol. 8, no. 5, pp. 317-327, March 2010.

[10] C. Whitfield, "Biosynthesis and assembly of capsular polysaccharides in *Escherichia coli*," Annu. Rev. Biochem., vol. 75, pp. 39-68, 2006.

[11] J. R. Meyer, D. T. Dobias, J. S. Weitz, J. E. Barrick, R. T. Quick, and R. E. Lenski, "Repeatability and contingency in the evolution of a key innovation in phage lambda," Science, vol. 335, no. 6067, pp. 428-432, January 2012.

[12] D. S. Gupta et al., "Coliphage K5, specific for *E. coli* exhibiting the capsular K5 antigen," FEMS Microbiol. Lett., vol. 14, no. 1, pp. 75-78, May 1982.

[13] R. J. Gross, T. Cheasty, and B. Rowe, "Isolation of bacteriophages specific for the K1 polysaccharide antigen of *Escherichia coli*," J. Clin. Microbiol., vol. 6, no. 6, pp. 548-550, December 1977.

[14] D. Schwarzer et al., "A Multivalent Adsorption Apparatus Explains the Broad Host Range of Phage phi92: a Comprehensive Genomic and Structural Analysis," J. Virol., vol. 86, no. 19, pp. 10384-10398, October 2012.

[15] F. Tétart, F. Repoila, C. Monod, and H. M. Krisch, "Bacteriophage T4 host range is expanded by duplications of a small domain of the tail fiber adhesin," J. Mol. Biol., vol. 258, no. 5, pp. 726-731, May 1996.

[16] E. Haggård-Ljungquist, C. Halling, and R. Calendar, "DNA sequences of the tail fiber genes of bacteriophage P2: evidence for horizontal transfer of tail fiber genes among unrelated bacteriophages.," J. Bacteriol., vol. 174, no. 5, pp. 1462-1477, March 1992.

[17] L.-T. Wu, S.-Y. Chang, M.-R. Yen, T.-C. Yang, and Y.-H. Tseng, "Characterization of Extended-Host-Range Pseudo-T-Even Bacteriophage Kpp95 Isolated on *Klebsiella pneumoniae*," Appl. Environ. Microbiol., vol. 73, no. 8, pp. 2532-2540, April 2007.

[18] D. Montag, H. Schwarz, and U. Henning, "A component of the side tail fiber of *Escherichia coli* bacteriophage lambda can functionally replace the receptor-recognizing part of a long tail fiber protein of the unrelated bacteriophage T4," J. Bacteriol., vol. 171, no. 8, pp. 4378-4384, August 1989.

[19] E. R. Vimr, R. D. McCoy, H. F. Vollger, N. C. Wilkison, and F. A. Troy, "Use of prokaryotic-derived probes to identify poly(sialic acid) in neonatal neuronal membranes," Proc. Natl. Acad. Sci., vol. 81, no. 7, pp. 1971-1975, April 1984.

[20] K. Stummeyer, A. Dickmanns, M. Mühlenhoff, R. Gerardy-Schahn, and R. Ficner, "Crystal structure of the polysialic acid-degrading endosialidase of bacteriophage K1F," Nat. Struct. Mol. Biol., vol. 12, no. 1, pp. 90-96, January 2005.

[21] D. Scholl, S. Adhya, and C. Merril, "*Escherichia coli* K1's Capsule Is a Barrier to Bacteriophage T7," Appl. Environ. Microbiol., vol. 71, no. 8, pp. 4872-4874, August 2005.

[22] Y. Jiang, B. Chen, C. Duan, B. Sun, J. Yang, and S. Yang, "Multigene Editing in the *Escherichia coli* Genome via the CRISPR-Cas9 System," Appl. Environ. Microbiol., vol. 81, no. 7, pp. 2506-2514, April 2015.

[23] J. E. Cronan, "Improved Plasmid-Based System for Fully Regulated Off-To-On Gene Expression in *Escherichia coli*: Application to Production of Toxic Proteins," Plasmid, vol. 69, no. 1, pp. 81-89, January 2013.

[24] J. E. Thompson et al., "The K5 Lyase KflA Combines a Viral Tail Spike Structure with a Bacterial Polysaccharide Lyase Mechanism," J. Biol. Chem., vol. 285, no. 31, pp. 23963-23969, July 2010.

[25] S. C. Potter, A. Luciani, S. R. Eddy, Y. Park, R. Lopez, and R. D. Finn, "HMMER web server: 2018 update," Nucleic Acids Res., vol. 46, no. W1, pp. W200-W204, July 2018.

[26] E. I. Marusich, L. P. Kurochkina, and V. V. Mesyanzhinov, "Chaperones in bacteriophage T4 assembly," Biochem. Biokhimiia, vol. 63, no. 4, pp. 399-406, April 1998.

[27] J. Xu, R. W. Hendrix, and R. L. Duda, "Chaperone-protein interactions that mediate assembly of the bacteriophage lambda tail to the correct length," J. Mol. Biol., vol. 426, no. 5, pp. 1004-1018, March 2014.

[28] D. Schwarzer et al., "Proteolytic Release of the Intramolecular Chaperone Domain Confers Processivity to Endosialidase F," J. Biol. Chem., vol. 284, no. 14, pp. 9465-9474, April 2009.

[29] J. A. Gilbert, M. J. Blaser, J. G. Caporaso, J. K. Jansson, S. V. Lynch, and R. Knight, "Current understanding of the human microbiome," Nat. Med., vol. 24, no. 4, pp. 392-400, April 2018.

[30] M. Kapitan, M. J. Niemiec, A. Steimle, J. S. Frick, and I. D. Jacobsen, "Fungi as Part of the Microbiota and Interactions with Intestinal Bacteria," Curr. Top. Microbiol. Immunol., vol. 422, pp. 265-301, 2019.

[31] V. D. Nkamga, B. Henrissat, and M. Drancourt, "Archaea: Essential inhabitants of the human digestive microbiota," Hum. Microbiome J., vol. 3, pp. 1-8, March 2017.

[32] M. Arumugam et al., "Enterotypes of the human gut microbiome," Nature, vol. 473, no. 7346, pp. 174-180, May 2011.

[33] M. I. McBurney et al., "Establishing What Constitutes a Healthy Human Gut Microbiome: State of the Science, Regulatory Considerations, and Future Directions," J. Nutr., vol. 149, no. 11, pp. 1882-1895, November 2019.

[34] R. Nagpal et al., "Gut microbiome and aging: Physiological and mechanistic insights," Nutr. Healthy Aging, vol. 4, no. 4, pp. 267-285.

[35] R. K. Singh et al., "Influence of diet on the gut microbiome and implications for human health," J. Transl. Med., vol. 15, April 2017.

[36] O. Tenaillon, D. Skurnik, B. Picard, and E. Denamur, "The population genetics of commensal *Escherichia coli*," Nat. Rev. Microbiol., vol. 8, no. 3, pp. 207-217, March 2010.

[37 F. L. Nowrouzian, A. E. Wold, and I. Adlerberth, "*Escherichia coli* strains belonging to phylogenetic group

[38] M. Smati et al., "Quantitative analysis of commensal *Escherichia coli* populations reveals host-specific enterotypes at the intra-species level," MicrobiologyOpen, vol. 4, no. 4, pp. 604-615, August 2015.

[39] P. Hyman, "Phages for Phage Therapy: Isolation, Characterization, and Host Range Breadth," Pharmaceuticals, vol. 12, no. 1, March 2019.

[40] R. Pantůcek et al., "The polyvalent staphylococcal phage phi812: its host-range mutants and related phages," Virology, vol. 246, no. 2, pp. 241-252, July 1998.

[41] A. Ross, S. Ward, and P. Hyman, "More Is Better: Selecting for Broad Host Range Bacteriophages," Front. Microbiol., vol. 7, September 2016.

[42] H. Ochman and R. K. Selander, "Standard reference strains of *Escherichia coli* from natural populations," J. Bacteriol., vol. 157, no. 2, pp. 690-693, February 1984.

[43] L. Goodridge, A. Gallaccio, and M. W. Griffiths, "Morphological, Host Range, and Genetic Characterization of Two Coliphages," Appl. Environ. Microbiol., vol. 69, no. 9, pp. 5364-5371, September 2003.

[44] M. K. Mirzaei and A. S. Nilsson, "Isolation of Phages for Phage Therapy: A Comparison of Spot Tests and Efficiency of Plating Analyses for Determination of Host Range and Efficacy," PLOS ONE, vol. 10, no. 3, p. e0118557, March 2015.

[45] E. C. Keen, "Tradeoffs in bacteriophage life histories," Bacteriophage, vol. 4, no. 2, p. e28365, April 2014.

[46] D. Scholl and C. Merril, "The Genome of Bacteriophage K1F, a T7-Like Phage That Has Acquired the Ability To Replicate on K1 Strains of *Escherichia coli*," J. Bacteriol., vol. 187, no. 24, pp. 8499-8503, December 2005.

[47] D Montag et al, «A component of the side tail fiber of *Escherichia coli* bacteriophage lambda can functionally replace the receptor-recognizing part of a long tail fiber protein of the unrelated bacteriophage T4» J. Bacteriol., 171(8), pp. 4378-4384, August 1989

```
SEQUENCES
1) INSERTION POINT ADAKKS
STF-25
```
(SEQ ID NO: 2)
```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSETAAASSRNAAKTSETNAGNSAKAAASSKTAAQNAATAAER

SETNARASEEASADSEEASRRNAESAAENAGVATTKAREAAADATKAGQKKDEALSA

ATRAEKAADRAEAAAEVTAEPCANIVPPLPDVWIPFNDSLDMIAGFSPGYKKIAIGD

DVVQVASDKQVNFSRASTATYINKSGELKTAEINEPRFECDGLLIEGQRTNYMLNSE

SPASWGKSSNMDVPETGTDSFGFTYGKFVCNDSLVGQTSAINMASIAATKSVDVSGD

NKYVTTSCRFKTERQVRLRIRFDKYDGSATTFLGDAYIDTQTLEISMTGGAAGRITA

RVRKDKTTGWIFAEATIQAIDGELKIGSQIQYSPGQGGATVSGDYIYLATPQVENGP

CVSSFIISGGSATTRASDLVSIPTRNNLYKLPFTFLLEIHKNWDIAPNAAPRVWDIA

AANTGQSAIAAINRGSGKLYMSLSNPSGSYVNSAATDVFAEKTTFGCIAKADGHFHV

VTNGKAVNEVYCEYNGVTADKNIRFGGQTNTGERHLFGHIRNFRIWHKELNDRQLKE

VV

STF25-AP1
```
(SEQ ID NO: 3)
```
MKDLTLKFHDKLQFKAFLSSLGWAEDEDLQNKLLVDEIGFTYTETGVTEEGEPVCIR

NDGYFVNIRILDDLFDVSVFSDYVVELETPLREWS

STF-27
```
(SEQ ID NO: 4)
```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSETAAASSKNAAKTSETNAANSAQAAAASQTASANSATAAKK

SETSAKNSETATKASEKNAKSSQTAAKTSETNAKDSEANAKVSETAAANSAKASAAS

QTAAKASEDAAREYANQTAEPYRYVLQPLPDVWIPFNDSLDMITGYSPGYKKVKIGD

NVVQVASDKQVNFSRASTATYINKSGELKTAEINEPRFECDGLLIEGQRTNFFQNST

DPSKWNKSTSLDVTETGTDSFGFNYGRFVVQDSIVGTSKAHTIIGLYSSTGGVDTSG

DEKHVTISCRVKSEVDNIAVRILFEHYDGEVRTSIGAANLNLTTRIISKTGQTSRVT

ARSVKDDATGWIFFEATLKADTTENTVGGFVQYSPDTGQMVTSGDYLDVTTPQIEAG
```

-continued

TGASSFIVTGTAPATRASDMVTVPIKNNLYNLPFTVLCEVHKNWYKTPNVAPRVFDT

GGHQTGAGIVMGFGSSGGYDGFPYCDIGGSDRRINENAGLEKMLIGMRVKSERSTCV

VSNGKLSSETKTKWEYIRSTATIRIGGQTTAGLRHLFGHVRNFRLWHKELTDAQLGE

VVE

STF27-AP1

(SEQ ID NO: 5)

VRDFTLRFSDKADFRAFLRKLNWEEDEELQNAVLVDEIGFTFRETDVSDDGEPEYTR

NEGYFVNIRLLDDGFEDSVFREWVVTPERPLREWF

STF27-AP2

(SEQ ID NO: 6)

MLPQHSDIEIAWYASIQQEPNGWKTVTTQFYIQEFSEYIAPLQDAVDLEIATEEERS

LLEAWNKYRVLLNRVDTSTAPDIEWPTSPAE

>STF-28

(SEQ ID NO: 7)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSETAAASSRNAAKTSETNAGNSAKAAASSKTAAQNAATAAER

SETNARASEEASADSEEASRRNAESAAENAGVATTKAREAAADATKAGQKKDEALSA

ATRAEKAADRAESAAEVTAEPCANIVPPLPDVWIPFNDSLDMITGFSPSYKKIVIGD

DEITMPGDKIVKFKRASTATYINKSGQLKLAEVDEPRFERDGLLIEGQRTNYLRNSN

KPDSWTVHSALNKTFGTDKQGFNYATVTPTESIVGTTGGYTVHGVVAADRFPLASGE

CFTFSCRVKGAKARCRLRVSVIIGGTDTFSADSYLDLDTRIATVSGNTSLITAKAEQ

QGEWTYYEATYTANTDIDTVNCAFYMTNKISNEPFYDDSTLTMTTPQIELGNTASSF

IVTTMPTTRASDVVTIPSANNLSTRPFTVLCEVRRNWSTPPNVAPRIFDVGGHSIDD

NYLSLGFVSTGKISANVGMVQPQISSDGERFIVGVRAKSDLSVNAICNGNYTTNLNG

KIFGVTATSYRFGGQTAAGTRHLFGHIRNFRVWFKELNDRQIKEAV

STF28-AP1

(SEQ ID NO: 8)

MKDLTLKFPGNREFKSFLSSLDWEEDEDLQNKLLVDEIGFTYTETGVTEEGEPVCIR

NNGYFVNIRILDDLFDVSVFSDYVVELETPLREWS

2) INSERTION POINT SASAAA
STF-15

(SEQ ID NO: 9)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAAASATASANSQKAAKTSETNAKVSETAAANSAKASAASQTAAKASED

AAREYASQAAEPYKYVLQPLPDVWIPFNDSLDMITGFSPSYKKIVIGDDEITMPGDK

VVKFKRASTATYINKSGVFSVAKIDEPRFEKEGLLIEGQRTNYFVKSNTPAEWTSTS

NIDKTNNGVDEFGFSYAKMRTKDNMTGQSSALSLHRCSASRGIDVSGDNKYCTVSCR

VKAPDGLRCRLRFEKYDGSVYTFLGDAYLTFGTLIIEKTGGAANRIAATATKDPVTG

WIFYEATIEAVEGETLIGAMIQYAPKKGGITEAGDYIYLATPQFENGGCASSFVITT

TAPATRSSDMVTIPTKNNIYNRPLTCLVEVNRIWGDIPPNVAPRIFDFSGVPPIESI

TYAFNTTEKYYGQLYMQTYKASTSTYVSSVFAGRADVRKFIGGFNIYSDGTKRVVSN

-continued

GEATKTMKTEWTGVKTRTFIRIGGQATSGTRHLFGHLRNLRLWHKELTDAQMGESIK

STF15-AP1

(SEQ ID NO: 10)

MKDLTLKFADRADFSAFMESIGYYDDESMQDDILIDVIGNVYKETGELTEDGEPACV

KEDGYFVNVRIINDSQISSLFDEHAVAVEHQLRSWM

STF15-AP2

(SEQ ID NO: 11)

MATSTVIPDDIKTLKGDVSKAKEDISSINVKVSTLQTDMDSAKQDISTRYTKTEVDN

KLKNKVEVNDLESGRYGGDFYPLTGREAFYLWGLGTTTAAANLYLNPDDPAISSVLRS

TSSIRYKHSVETIDSEHADLIFRMRPVWYRSQCENDRRDWGFYGLIAEEVGEIAPQF

VHWRPANEDDAPETISSNGLVAEGVMYERLVVPLIHHIQKLTERVDELESELKLLST

SQSDIG

STF-16

(SEQ ID NO: 12)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAAASATASANSQKAAKTSETNAKTSETAAANSAKASAASQTAAKASED

AAREYASQAADPYKYVLQPLPDVWIPFNDSLDMITGFSPSYKKIVIGDDEITMPGDK

IVKFKRASKATYINKSGVLTEAAIDEPRFERDGLLIEGQRTNLLLNSTNPSKWNKSG

NLELTEISTDSFNFTYGRFTVKDTLIGQTSAININVTISGSKGFDVTGDEKYVTISCR

VRSDVENIRCRLRFEHHDGYTYTFLGDAYLNLSTLVIDKTGTAADRIIAKAVKDEVT

GWIFYQATINALDTESMIGAMVQYAPVKGSGTASGDYLDIATPQVEGGSSASSFIVT

DITASTRASDMVTVPIKNNLYNLPFTVLCEVHKNWYKTPNAAPRVFDTGGHQTGAAI

ILGFGRSTDYDGFPYCDIGLANRRVNENASLEKMVMGMRVKSDQSTCSVSNGRISSE

KKATWSYIQNSAIIRIGGQTTAGLRHLFGHVRNFRIWHKALTDAQMGESI

STF16-AP1

(SEQ ID NO: 13)

MKDLTLKFADRADFSAFMDSIGYYDDESMQDDILIDVIGNVYKETGELTEDGEPVCV

KEDGYYVNVRIINDAKKSSIFDEYAVVVEHQLRGWM

STF16-AP2

(SEQ ID NO: 14)

MATSTVIPGDITTLKGDVSKAKEDISSINGKVSTLQADMTSAKQDISTRYTKTEVDN

KLKNKLEVNALESGRYGGDFYPLTGREAFYLWGLGTTTAAANLYLNPDDPAISSVLRS

TSSIRYKHSVETIDSEHADLIFRMRPVWYRSQCENDRRDWGFYGLIAEEVGEIAPQF

VHWRPANEDDAPEAISSNGLVAEGVMYERLVVPLIHHIQKLTERVDELESELKLLSV

SRSDIG

STF-17

(SEQ ID NO: 15)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

-continued

TAAERSASAAAGSKTAAALSASAASTSAGQASASATAAGKSAESAASSSASTATTKAG

KATEQATAAARSASAAKTSETNAKTSADNAASSKAAAASSASSAASSSASSASASKDE

ATRQASAAKGSATTASTKATEAAGSATAAAQSKSTAESAATRAETAAKRAEDIASAV

ALEDASTTKKGIVQLSSATNSTSESLAATPKAVKAVMGETNKKAPLNSPALTGTPTT

PTARQGTNNTQIASTAYVMAAIAALVDSSPDALNTLNELAAALGNDPNFATTMTSAL

AGKQPKDATLTALAGLATAADRFPYFTGNDVASLATLTKVGRDILAKSTVAAVIEYL

GLRELGTSGEKIPLLSTANTWTNRQTFSGGLSGELSGNASTAAKLKTARKISNVAFD

GSSDITLKASHVGAFALGKTGSTVANDKAVGWNWSSGAYNATISGASTLIIHFYMGE

GSCPAAQFRINYKNGGIFYRSARDGYGFEADWSEFYTTTRKPSAGDVGALPLSGGQL

NGALGIGTSSALGGNSIVLGDNDTGFKQNGDGNLDVYANNVHVMRFVSGSIQSNKTI

NITGRVNPSDYGNFDSRYVKDVRLGSQQYYGVNNWQTWNFQCPSGHVLSGINVQDTG

SNSADNIAGVYYRPVQKYINGTWYNVASV

STF17-AP1 (SEQ ID NO: 16)

MMHLKNIKAGNAKTLEQYELTKKHGVIWLYSEDGKNWYEEVKNFQPDTIKIVYDENN

IIVAITKDASTLNPEGYSVVEIPDITANRRADDSGKWMFKDGAVIKRVYTEEELRLQ

TENQKKILLQQAREKTQFWQTQLTLGIITDSDRQQLMNWMRYVQQVETTDTSVLPVT

FPEPPE

STF-13 (SEQ ID NO: 17)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAASSATASANSQKAAKTSETNAKASETAAANSAKASAASQTAAKASED

AAREYASQAAEPYKQVLQPLPDVWIPFNDSLDMLAGFSPGYKQITVGDDVIKMPSDK

VVSFKRASGATYINKSGVLTVAEVDEPRFEREGLLIEGQRTNYHLNSLTPSKWGATT

SVTITESGVDEFGFTYGRFQIKDEKIGTNTTMNIAAVSGGRGVDVTGTEKYVTTSCR

VKSDSANIQCRIRFERYDGSAYFYLADAYLNITDMSIRKTGGGAARITARAEKESNG

WIYFEVTYQSEAIDNMVGSQIQIAPPVSPGTYLGGEYLDVTTPQFEGGSCASSFIIS

DTVASTRASDIVTLPCKNNMASKPLTCMVEVNKNWSIAPNSAPRIYDITGFKTKDDA

FVFAFRNTAGSVGTPYVQFGNPISFPPGNYPRKIIAVYRIKSDGKFQAGCNGVLSTP

ASTTWKSVSGATGIRIGGQTTAGLRHLFGYIRNFRIWHKELTDAQMGEII

STF13-AP1 (SEQ ID NO: 18)

MRDLIIKFTDKADFSAFMKSAGYYDDESMQDDILIDVIGNVYKETGELTEDGEPVCV

KEDGYFVNVRIINDAKKSSIFDKYAVVVEHQLRGWM

STF13-AP2 (SEQ ID NO: 19)

MATSTVIPGDITKLKGDVSKAKEDISSISRKVSTLQTEMTSAKQDISSRYTKTEVDN

KLKNKVEVNDLESGRYGGDFYPLTGREAFYLWNLATTTAAANLYLNPDPAISSVLRS

TSSIRYKHSVETIDSEHADLIFRMRPVWYRSQCENDRRDWGFYGLIAEEVGEIAPQF

VHWRPANEDDAPEAISSNGLVAEGVMYERLVVPLIHHIQKLTERVDELESELKLLLT

SRSDIR

STF-12

(SEQ ID NO: 20)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAAASATASANSQKAAKTSETNAKTSETAAANSAQASAASQTAAKASED
AAREYASQAAEPYKYVLQPLPDVWIPFNDSLDMLAGFSPGYKQITVGDDVIKMPSDK
VVSFKRASGATYINKSGVLTVAEVDEPRFEREGLLIEGQRTNYFRNSNTPEAWNNTG
SVSVESFDSDKGFNYGRITVINENPTAQGYQAIAVNTNDAYTCPAGSYTTISCLTKS
DNSRCRARFGKMSDNGAFVFHSDAVLDPVTGNVVHGNNVTVTAERVGEWWLFTATLF
ADAEMIISSRFEILAMPGISIIPNGSTLDIAMPQAEIGSYRTSFIITEGAPGTRSSD
MVTIPVRNNIHRLPFSALVEVNKNWDIPPSKSPLIFNVKDYQENGLFTHGFRGNNFS
DAGSPFISMGGCNKYVATTQRKIISGFRCGADGDVQAVCNGELSVAAKTTWTSIVPR
AVLRIGGQGTNGEYHLFGHIRNLRIWHKELTDAQMGESIK

STF12-AP1

(SEQ ID NO: 21)

MKDLTLKFADRADFSAFMESIGYYDDESMQDDILIDVIGNVYKETGELTEDGEPVCV
KEDGYFVNVRIINDVKKSSIFDKYAVVVEHQLRGWM

STF12-AP2

(SEQ ID NO: 22)

MATSTVIPGDITTLKGDVSKTKEDISSINGKVSTLQTDMTSAKQDISTRYTKTEVDN
KLKNKLEVNDLESGRYGGDFYPLTGREAFYMWGLGTTTAAANLYLNPDPAISSVLRS
TSSIRYKHSVETIDSEHADLIFRMRPVWYRSQCENDRRDWGFYGLIAEEVGEIAPQF
VHWRPANEDDAPEAISSNGLVAEGVMYERLVVPLIHHIQKLTERVDELESELKLLSV
SRSDIG

STF-63

(SEQ ID NO: 23)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAANSATAAKKSETNAKNSESAAKVSETNAKASENKAKEYLDKVGGLVS
PMTQYDWPVVTGNESFYIKIAKLSDPGSNNCHVTLMVTNGGDYGSPYGNIDFIEISA
RGLPSSLTADNVSRYLSIRRLGPTGLINSMQMRYGLVKDDGFIEVWAFQRAFINGAK
VAVLAQTARTELYIPDGFVKQTAAPSGYVESPVVRIYDQLNKPTKADLGLSNAMLTG
AFGLGGSGISTNGKMSDVEILKALRDKGGHFWRGDKPTGSTATIYSHGSGIFSRCGD
TWSAINIDYSTAKIKIYAGNDARLNNGTFSINELYGSANKPSKSDVGLGNVTNDAQV
KKTGDTMTGDLTIKKGTPSVFLRADSGVTALRFYTGDNTERGIIYAGPNTDSLGEVR
IRAKTAGGTSGGDLVVRH

STF-62

(SEQ ID NO: 24)

MAVKISGVLKDGTGKPVQNCTIQLKARRNSTTVVVNTVGSENPDEAGRYSMDVEYGQ

-continued

```
YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAANSATAAKKSETNAKNSEAAAKVSETNAKASENKAKEYLDKVGGLVS

PMTQYDWPVVTASESLYIKIAKLSDPGTSRSHVTLMVTNAGNYGSPYGNIDFIEISA

RGLPSLLSADNVSRHLSIRRLGSTGLTDNNQMRYGLVKGDGFIEVWAFQGAFINDAK

VAVLAQTTLNTELYIPDGFVKQTAAPSGYIEGNVVRIYDQVNKPTKADLGLSNAMLT

GAFGLGGSGISTNGKMSDVEILKALRDKGGHFWRGDKPTGSTATTYSHGSGIFSRCG

DTWSAINIDYSTAKIKIYAGNDARLNNGTFSVNELYGSANKPSKSDVGLGNVTNDAQ

VKKSGDVMSGDLDILKETPSIRLKSAKGTAHLWFMNNDGSERGVVWSPENNESLGEI

HIRAKNTKGESSGDFIVRHDGRVEARNLKITYKISAATAEFANTSTSSDNTTVSIKG

SQHTPLVLTSNNTIKNLSIGFKVDDVDQKYLGIAGDGDLYFGSYSDHTKNSKVITQA

KLDSGVTVGGKTTFSDLATFNAGMAGSIEPETIDNKTIDLNDLIIANTVAGSVKYYQ

CKTVAGGAYITNKPDGVSGNFLLRVESTRKTTGSDYAIMQTLIGSDTKRIYVRFVVN

GSWTEWSQVVVSGWNQDVTVRSLTSTTPSKLGGGRVDVLGSTSDYSSMNCAVRGVDS

TGTNSAWSVGTSKNTGKMLCLKNHRSSAQVLLNGDDGAVQLLSGTVNGATAQALTIN

KDEVNSTADLVIRKQTGTGNRFALLNSGNSELPVGIRVWGSSTRQNVFEVGTSTAYL

FYAQKTSAGQLFDVNGAINCTTLNQSSDRDLKDDILVISDATKAIRKMNGYTYTLRE

NGMPYAGVIAQEVMEAIPEAVGSFTHYGEELQGPTVDGNELREETRYLNVDYAAVTG

LLVQFARETDDRVTALEEENTTLRQNLATADTRISTLENQVSELVALVRQLTGSEH
```

STF-71                                                           (SEQ ID NO: 25)

```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAASSATASANSQKAAKTSETNAKASETAAANSAKASAASQTAAKASED

AAREYASQAAEPYKQVLQPLPDVWIPFNDSLDMITGFSPSYKKIVIGDDEITMSGDK

VVKFKRASKATYINKSGVLTEAAIDEPRFERDGLLIEGQRTNYMLNSESPASWGRSS

NMDVPETGTDNFGFTYGKFVCNDSLIGQTSAINMASIAATKSVDVSGDNKHVTTSCR

FKTELQVRLRIRFDKYDGSATTFLGDAYIDTQTLEINMTGGAASRITARVRKDEATG

WIFAEATIQAIDGELKIGSQIQYSPKQGGATVSGDYIYLATPQVENGPCVSSFIISG

TTAATRASDIVTVPIKNNLYNLPFTVLCEVHKNWYKTPNAAPRVFDTGGHQTGAAII

LGFGSSADYDGFPYCDIGGANRRVNENALLEKMVMGMRVKSDQSTCSVSNGRISSET

KTTWSYIQNTAIIRIGGQTTAGLRHLFGHVRNFRIWHKALTDAQVGESI
```

STF71-AP1                                                        (SEQ ID NO: 26)

```
MKDLTLKLADRADFSAFMESTGYYDDESMQDDILIDVIGNVYKETGELNEDGEPVCV

KEDGYFVNVRIINDVKTPSIFDEYVVAVEHQLRGWM
```

3) INSERTION POINT MDETNR
STF-20                                                           (SEQ ID NO: 27)

```
MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRRLAKNQ
NGADIQDKSAFLDNIGVTSLTFMKNNGEMPVDADLNTFGPVKAYVGVWYKSTSSNAT
LEKNFPEDGAVGVLEVFNGGNFSGMQRYTTRTGNVYMRNLSGTWNGSDGPWIWRQIQ
SATRPLSTTIDLNTLGGAEHLGLWRNSSGSIASFDRNYPEEGSYQGFLEVLEGGGY
SRTQRYTTRRGNVYVRCLSAIWNAQNPQWEPWSRVGHQSECRYYEGDLNDLTSPGIY
SVTGKASNGPMQDTAGATLLGILEVIRRFDGVSVWQRYTTTGKSETTQGRTFERVYA
GSKWTEWREVYNSFSLPLNLGIGGAVAKLSSLDWQTYDFVPGSLITVRLDNMTNIPD
GMDWGVIDGNLINISVGPSDDSGSGRSMHVWRSTVSKANYRFFMVRISGNPGSRTIT
TRRVPIIDEAQTWGAKQTFSAGLSGELSGNAATATKLKTARKINNVSFDGTSDINLT
PKNIGAFASGKTGDTVANDKAVGWNWSSGAYNATIGGASTLILHFNIGEGSCPAAQF
RVNYKNGGIFYRSARDGYGFEADWSEFYTTTRKPTAGDVGALPLSGGQLNGALGIGT
SSALGGNSIVLGDNDTGFKQNGDGNLDVYANSVHVMRFVSGSVQSNKTINITGRVNP
SDYGNFDSRYVRDVRLGTRVVQTMQKGVMYEKAGHVITGLGIVGEVDGDDPAVFRPI
QKYINGTWYNVAQV
```

STF20-AP1                                                    (SEQ ID NO: 28)

```
MQHLKNITAGNPKTVAQYQLTKNFDVIWLWSEEGKNWYEEVSNFQEDTIKIVYDENN
IIVGITRDASTLNPEGFSVVEVPDITANRRADDSGKWMFKDGAVIKRIYTADEQLQL
AELQKSALLSEAETIIQPLERSVRLNMATDDERSRLEAWERYSVLVSRVDPANPEWP
EMPQ
```

STF-23                                                       (SEQ ID NO: 29)

```
MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLNS
PALTGTPTTPTARQGTNNTQIASTAFVMAAIAALVDSSPDALNTLNELAAALGNDPN
FATTMTNALAGKQPKDATLTALAGLATAADRFPYFTGNDVASLATLTKVGRDILAKS
TVAAVIEYLGLRELGTSGEKIPLLSTANTWTNRQTFSGGLSGGLSGNAATATKLKTA
RKIAGVGFDGSSDISISAKNVNAFALRQTGNTVNGDTSVGWNWDSGAYNALIGGASA
LILHFNINAGSCPAVQFRVNYKNGGISYRSARDGYGFELGWSDFYTTTRKPSAGDVG
AYTRAECNSRFITGIRLGGLSSVQTWNGPGWSDRSGYVVTGSVNGNRDELIDTTQAR
PIQYCINGTWYNAGSI
```

STF23-AP1

-continued

MMHLKNITAGNPKTKEQYQLTKQFNIKWLYSDDGKNWYEEQKNFQPDTLKMVYDHNG
VIICIEKDVSAINPEGASVVELPDITANRRADISGKWLFKDGVVIKRTYTEEEQRQQ
AENEKQSLLQLVRDKTQLWDSQLRLGIISDENKQKLTEWMLYAQKVESTDTSSLPVT
FPEQPE

STF-24
(SEQ ID NO: 31)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRRLQKDQ
NGADIPDKRLFLRNIGATNSTTMSFSGGTGWFRLATVTNIPQASSVVYISLIGGAGY
NVNSPMQAGISELVLRAGNGNPKGLTGALWRRTSVGFTNFAWVNTSGDTYDVYVEIG
NYATGVNIQWDYTSNASVTIHTSPTYTANKPTGLTDGTVYVIYSSYIKPTAADVGAL
SLSGGQLNGALGIGTSSALGGNSIVLGDNDTGFKQNGDGNLDVYANSVHVMRFVSGS
VQSNKTINITGRVNPSDYGNFDSRYVRDVRLGTRVVQTMQKGVMYEKAGHVITGLGI
VGEVDGDDPAVFRPIQKYINGTWYNVAQV

STF24-AP1
(SEQ ID NO: 32)

MQHLKNITAGNPKTVAQYQLTKNFDVIWLWSEEGKNWYEEVSNFQEDTIKIVYDENN
IIVGITRDASTLNPEGFSVVEVPDITANRRADDSGKWMFKDGAVIKRIYTADEQLQL
AELQKSALLSEAETIIQPLERSVRLNMATDEERSRLEAWERYSVLVSRVDPANPEWP
EMPQ

O111-2.0
(SEQ ID NO: 33)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLNS
PALTGTPTTPTAPQGTNSTQIASTAFVMAAIAALVDSSPDALNTLSELAAALGNDPN
FATTMTNALAGKQPKDATLTALAGLVTAADRFPYFTGNDVASLATLTEVGRDILAKS
TVAAVIEYLGLQETVNQASGALQKNQNGADIPGKDTFTKNIGACRAYSAWLNIGGDS
QVWTTAQFISWLESQGAFNHPYWMCKGSWAYANNKVITDTGCGNICLAGAVVEVIGT
RGAMTIRVTTPSTSSGGGITNAQFTYINHGDAYAPGWRRDYNTKNQQPAFALGQTGS
RVANDKAVGWNWNSGVYNADISGASTLILHFNMNAGSCPAVQFRVNYRNGGIFYRSA
RDGYGFEANWSEFYTTTRKPSAGDVGAYTQAECNSRFITGIRLGGLSSVQTWNGPGW
SDRSGYVVTGSVNGNRDELIDTTQARPIQYCINGTWYNAGSI

O111 2.0-AP1
(SEQ ID NO: 34)

```
MMHLKNITAGNPKTKEQYQLTKQFNIKWLYSEDGKNWYEEQKNFQPDTLKMVYDHNG

VIICIEKDVSAINPEGASVVELPDITANRRADISGKWMFKDGVVVKRTYTEEEQRQQ

AENEKQSLLQLVRDKTQLWDSQLRLGIISDENKQKLTEWMLFAQKVESTDTSSLPVT

FPEQPE
```

STF-74                                                          (SEQ ID NO: 35)

```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKYTAQD

ASTAQKGLVKLSSATDSTSETLAATPKAVKAVNDNANGRVPSERKVNGHSLAGDISV

TSQDIFDGQCVEIGPGQDLDNYQTPGLYFQPANANTSAALHYPENNAGSLMVLRSAG

ITQVYRVYSGSRSYLRSKYSTQPWTTWTPDDAFPVGAPIPWPSDIAPPAYALMQGQS

FDKSAYPLLAVAYPSGVIPDMIRGQTIKGKPDGRAVLSYEQDGIKSHAHTASISDTD

LGTKYTNSFDYGSKPTTSFDYGNKSSTEGGWHVHNFRYCATSAYRDTPGSGLGMHSS

NISWSAGDRIEGSGNHAHVTWIGPHDHWVGIGEHNHYVVMGYHGHTATVHATGNTEN

TVKNIAFNYIVRLA
```

STF74-AP1                                                       (SEQ ID NO: 36)

```
MAFEMTGENRTIILYNLRSDTNEFIGKSDGFIPANTGLPAYSTDIAPPKVTAGFVAV

FDAQTNKWSRVEDYRGTTVYDISTGKPAVIEKLGALPDNVVSVAPDGEYVKWDGAKW

IHDAEAEKTFRQGQAAQEKSNLLMIATSAIAPLQDAVDLDMATEDEATALNEWKKYR

VMLNRVKPEDAPDITWPELPA
```

STF-86                                                          (SEQ ID NO: 37)

```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRRVPASR

KVNGHALNGDINVTSRDIFDGQVIAIGANKNLDDYQVPGLYFQEANNNTSAAMNYPE

NSAGSLMVLRGAGVTQVYRVYNSSRSYSRSKYSTLAWTPWMPEDSYPVGAPIPWPSD

VTPTGYALMQGQPFDKAVYPLLAIAYPAGIIPDMRGQTIKGKPNGRAVLSYEQDGVI

SHTHGASISDTDLGTKYTSSFDYGSKPTTSFDYGNKSSTEGGWHAHNFRYCATSAYR

DTPGQGLGMHSSNVSWAAGDRIEGSGNHAHVTWIGPHDHWVGIGAHNHYVVMGYHGH

TATVHAAGNAENTVKNIAFNYIVRLA
```

STF86-AP1                                                       (SEQ ID NO: 38)

```
MTFEMTGENRTITIYNLRADTNEFIGKSDGFIPANTGLPANSTNIAPPPMKAGFVAV

FNSASEKWSLVEDHRGKIVYDILTGKSITIDELGQLPDDVVSVAPEGHFVKWNGKKW
```

-continued

VHDADAEKTAQITQATQQKDSLLALAASKIAPLQDAVDLDIATEEETALLLAWKKYR

VLINRIKPEDAPDIDWPEVPGDVA

STF-84 (SEQ ID NO: 39)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKYTAQD

ATTAQKGIVQLSNATNSTSEMLAATPKSVKAAYDLANGKYTAQDATTAQKGIVQLSS

ATNSASETLAATPKAANDNANGRVPSARKVNGKALSADITLTPKDIGTLNSTTMSFS

GGAGWFKLATVTNIPQASSVVSITLIGGAGFNVGSPQQAGISELVLRAGNGNPKGIT

GALWQRTSTGFTNFAWVNTSGDTYDIYVAIGNYATGVNIQWDYTSNASVTIHTSPAY

SANKPEGLTDGTVYSLYTPSGQFYPPGAPIPWPSDTVPSGYALMQGQTFDKSAYPKL

AAAYPSGVIPDMRGWTIKGKPASGRAVLSQEQDGIKSHTHSASASSTDLGTKTTSSF

DYGTKSTNNTGAHTHSVSGTAASAGNHTHSVTGASAVSQWSQNGSVHKVVSAASVNT

SAAGAHTHSVSGTAASAGAHAHTVGIGAHTHSVAIGSHGHTITVNAAGNAENTVKNI

AFNYIVRLA

STF84-AP1 (SEQ ID NO: 40)

MAFRMSEQPRTIKIYNLLAGTNEFIGEGDAYIPPHTGLPANSTYIAPPDIPAGFVAV

FNSDEGSWHLVEDHRGKTVYDVASGDALFISELGPLPENVTWLSPEGEFQKWNGTAW

VKDAEAEKLFRIREAEETKNSLMQVASEHIAPLQDAVDLEIATEEETSLLEAWKKYR

VLLNRVDTSTAPDIEWPTNPVRE

STF-93 (SEQ ID NO: 41)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRRVPSNR

KVNGKALTADITLTPKDIGTLNSVTMSFSGGAGWFKLATVTNIPQASSIVYIALIGG

AGYNVGSPHQAGISELVLRAGNGNPKGITGALWKRTAVGLTNFAWINTSGDTYDIYV

EIGNYATSVNIHWDCTANATVSIYTSPTYSASKPSSVTDGVVYTMYSTHQKPTPLDI

GALPTTGGTVSGPLSVTGGITGTLNGNASTATKLQTARSIGGVGFDGSANINLPGVN

TTGNQNTTGNAATATKLQTARTIGGVSFDGTANINLPGVNTTGNQNTTGNAATATKL

QTARTINGVSFDGSANISLSPANIGCPASPTGWLTTGSNGGAITTAQLVTLLQNNGA

FNTKSWIARCAWAYANSATIPNSETGCGVIPLAGAVIEVFNNGSSSNNYTIRITTAT

TTSVSGALTNAEFIYVFNGTDYSPGWRRVYNTKNKPTASDVGALPLTGGTLSGGLTS

-continued

SGEIISKYANGFRIAYGSFGFFIRNDGSNTYFMLTASGDTLGSWNGLRPITINNTSG

AVSIGNGLNVTGGVNGSLNGNASTATKLQTARNINGVKFDGSGDININTLVSRGRVT

ALSGSTQGTAGIQMYEAYNNSYPTTYGNVLHMKGASAAGEGELLIGWSGTSGAHAPV

FIRSRRDTTDAAWSAWAQLYTAKDSIPGVNTTGNQNTTGNAATATKLQTARKIAGVA

FDGSADITLTAANLNAYTKTEVTNLLSSYASRSSLTGYSGNLDIIAETLVVKSGGSG

GFAIWDIGTTTSGANMYIDPNPGINTVWRSTSSRRYKKDIETLQDRYADELLSLRPV

WYRSICRGDRKDWGYYGLIAEEVGEIAPQYVHWREPTNNDSPEDISSNGMVAEGVMY

ERLVVPLIHHIQQLTKRVEELETKLNSPKE

>STF-95    (SEQ ID NO: 42)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRRVPSAR

KVNGKALSADITLTPKDIGTLNSTTMSFSGGAGWFKLATVTNIPQASSVVSITLIGG

AGFNVGSPQQAGISELVLRAGNGNPKGITGALWQRTSTGFTNFAWVNTSGDTYDIYV

AIGNYATGVNIQWDYTSNASVTIHTSPAYSANKPEGLTDGTVYSLYTPSEQFYPPGA

PIPWPSDTVPSGYALMQGQTFDKSAYPKLAAAYPSGVIPDMRGWTIKGKPASGRAVL

SQEQDGIKSHTHSASASSTDLGTKNTSSFDYGTKSTNNTGAHTHSLSGSTGSAGDHT

HGNGIRWPGGGGSALAFYDGGGFTYVQDSQYQVSPGTSSRRSYYQRIQTQSAGAHTH

SLSGTAASSGAHAHTVGIGAHTHSVAIGSHGHTITVNAAGNAENTVKNIAFNYIVRL

A

STF95-AP1    (SEQ ID NO: 43)

MAFRMSEQARTIKIYNLLAGTNEFIGEGDAYIPPHTGLPANSTDIAPPDIPAGFVAV

FNSDEASWHLVEDHRGKTVYDVASGDELFISELGPLPENVTWLSPEGEFQKWNGTAW

VKDTEAEKMFRIREAEETKNNLMQVASEHIAPLQDAADLEIATEEETSLLEAWKKYR

VLLNRVDTSTAPDIEWPTNPVRE

STF-132    (SEQ ID NO: 44)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRAVQRDG

DTMTGELKIRGVNALRIFNDAFGLIFRRSEECLHLIPTSEGQGENGDIGPLRPFTIN

LRTGEISMSHKVSVGGGSQVNGALGIGVQNALGGNSIAFGDNDTGIKQNGDGILDVY

ANGQHVFRFQNGALQSHRAVNVSGRVTPTDYGNFDERYQTKTGGVQNFQYTSEVFHK

PAGNEVSWVFRAPSGCTLSGINVQETGSNSADNIGGVYYKQAQIYINGAWRSVSG

STF132-AP1 (SEQ ID NO: 45)

MALSIRLIKAKIMELRNVTRYYPENMPYGEGVQYFRSEDGQDFYESLDKFAKKYKLC
THPETGVIYSMAEDVSRLYPAGFTIVEVDELPDGFCIEARWYYKDGEVLPVPVDYRL
LAESERARLTAIAEREISDKKTDLLLGIINNGEKEMLKLWRMYIRNLKNIDFNHIHD
KSSFDSIKWPCDPENSH

4) INSERTION POINT GAGENS

K1F (SEQ ID NO: 46)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLDS
PALTGTPTAPTALRGTNNTQIANTAFVLAAIADVIDASPDALNTLNELAAALGNDPD
FATTMTNALAGKQPKNATLTALAGLSTAKNKLPYFAENDAASLTELTQVGRDILAKN
SVADVLEYLGAGENSGAKGDGVTDDTAALTSALNDTPVGQKINGNGKTYKVTSLPDI
SRFINTRFVYERIPGQPLYYASEEFVQGELFKITDTPYYNAWPQDKAFVYENVIYAP
YMGSDRHGVSRLHVSWVKSGDDGQTWSTPEWLTDLHPDYPTVNYHCMSMGVCRNRLF
AMIETRTLAKNALTNCALWDRPMSRSLHLTGGITKAANQRYATIHVPDHGLFVGDFV
NFSNSAVTGVSGDMTVATVIDKDNFTVLTPNQQTSDLNNAGKNWHMGTSFHKSPWRK
TDLGLIPSVTEVHSFATIDNNGFAMGYHQGDVAPREVGLFYFPDAFNSPSNYVRRQI
PSEYEPDASEPCIKYYDGVLYLITRGTRGDRLGSSLHRSRDIGQTWESLRFPHNVHH
TTLPFAKVGDDLIMFGSERAENEWEAGAPDDRYKASYPRTFYARLNVNNWNADDIEW
VNITDQIYQGGIVNSGVGVGSVVVKDNYIYYMFGGEDHFNPWTYGDNSAKDPFKSDG
HPSDLYCYKMKIGPDNRVSRDFRYGAVPNRAVPVFFDTNGVRTVPAPMEFTGDLGLG
HVTIRASTSSNIRSEVLMEGEYGFIGKSIPTDNPAGQRIIFCGGEGTSSTTGAQITL
YGANNTDSRRIVYNGDEHLFQSADVKPYNDNVTALGGPSNRFTTAYLGSNPIVTSNG
ERKTEPVVFDDAFLDAWGDVHYIMYQWLDAVQLKGNDARIHFGVIAQQIRDVFIAHG
LMDENSTNCRYAVLCYDKYPRMTDTVFSHNEIVEHTDEEGNVTTTEEPVYTEVVIHE
EGEEWGVRPDGIFFAEAAYQRRKLERIEARLSALEQK

K5 (SEQ ID NO: 47)

MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLDS
PALTGTPTAPTALRGTNNTQIANTAFVLAAIADVIDASPDALNTLNELAAALGNDPD
FATTMTNALAGKQPKNATLTALAGLSTAKNKLPYFAENDAASLTELTQVGRDILAKN

-continued

```
SVADVLEYLGAGENSPKTEGILHKGQSLYEYLDARVLTSKPFGAAGDATTDDTEVIA
ASLNSQKAVTISDGVFSSSGINSNYCNLDGRGSGVLSHRSSTGNYLVFNNPRTGRLS
NITVESNKATDTTQGQQVSLAGGSDVTVSDVNFSNVKGTGFSLIAYPNDAPPDGLMI
KGIRGSYSGYATNKAAGCVLADSSVNSLIDNVIAKNYPQFGAVELKGTASYNIVSNV
IGADCQHVTYNGTEGPIAPSNNLIKGVMANNPKYAAVVAGKGSTNLISDVLVDYSTS
DARQAHGVTVEGSDNVINNVLMSGCDTNSLGQRQTATIARFIGTANNNYASVFPSY
SATGVITFESGSTRNFVEVKHPGRRNDLLSSASTIDGAATIDGTSNSNVVHAPALGQ
YIGSMSGRFEWRIKSMSLPSGVLTSADKYRMLGDGAVSLAVGGGTSSQVRLFTSDGT
SRTVSLTNGNVRLSTSSTGYLQLGADAMTPDSTGTYALGSASRAWSGGFTQAAFTVT
SDARCKTEPLTISDALLDAWSEVDFVQFQYLDRVEEKGADSARWHFGIIAQRAKEAF
ERHGIDAHRYGFLCFDSWDDVYEEDANGSRKLITPAGSRYGIRYEEVLILEAALMRR
TIKRMQEALAALPK
```

STF-37                                                          (SEQ ID NO: 48)

```
MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLDS
PALTGTPTAPTALRGTNNTQIANTAFVLAAIADVIDASPDALNTLNELAAALGNDPD
FATTMTNALAGKQPKNATLTALAGLSTAKNKLPYFAENDAASLTELTQVGRDILAKN
SVADVLEYLGAGENSELSGEHGSFLIGGVIDCYSTVSDLISSSPSVGRVCRTIGYYS
PGDGGGADYIISIGTPMQDFSDSGSIVIDECKFAKLIQQSQYDLKQFGVKPSDPSYA
EKNDIFISQAITRSRVGRCKIIISDVIYHKKPLIFDYYNHMEGSCIGSDPEFTPRFI
KIDNTTSGLPDMGYPGVADVVSYDVDAGIIIKRQNSGTSFARGFIIKGFLLQSEKKS
AWAIYAPHMADFDIDIDSRGFNGGIRWFVNFLGRMAGRHIGLGANSSDPTLSIGAWC
SKFSTIPDCGNSVVFRLSFNGFNRGMQMEYFGNGVLDRVTLENISKPTPTSPTTHGI
YATDTWLTGQVSCESSSTCIIRAGNNANFDITLSAVFHVTQDDPSEGIVHVLNGGRL
TLRSSTILADLADTKIINENGGYLDIAANTRTGNIVYSNSDNYRFKDRTIGFGQTAA
TTKTSFSSGEEITFSLLNGTPKANLSGGTIQFNSPCLIKITVQGRGITSGALTFGIN
GESSESVSQGQQVSMVVGVVSGDILNLKATSSLTLGSAGGVRVLLEPVN
```

1JL                                                             (SEQ ID NO: 49)

```
MAVKISGVLKDGTGKPVQNCTIQLKARRNSTTVVVNTVGSENPDEAGRYSMDVEYGQ
YSVILQVDGFPPSHAGTITVYEDSQPGTLNDFLCAMTEDDARPEVLRRLELMVEEVA
RNASVVAQSTADAKKSAGDASASAAQVAALVTDATDSARAASTSAGQAASSAQEASS
GAEAASAKATEAEKSAAAAESSKNAAATSAGAAKTSETNAAASQQSAATSASTAATK
ASEAATSARDAVASKEAAKSSETNASSSAGRAASSATAAENSARAAKTSETNARSSE
TAAERSASAAADAKTAAAGSASTASTKATEAAGSAVSASQSKSAAEAAAIRAKNSAK
RAEDIASAVALEDADTTRKGIVQLSSATNSTSETLAATPKAVKVVMDETNRKAPLDS
```

-continued

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSGYKVQSLAILSDTQAVHDATNTIKTQTDKIKADTQAIKTQTN

QIKTETGVIRDKANTAKTDAQAASAAAQGFRDQAKEWAQSVNADNLLTKTGNLAGLT

DKSAARSNLGLGSVATENTVPIKKGGTAATTVAAARSNLGLGSVATENTVPIEKGGT

AATTAAKARSNLGLGSVATENTVPIEKGGTAATTAAKARSNFGLGDNNKVKLGTLRL

NGGESLVFNDVERNGLIISNASFGIDSWVGQTMHKWYTDWTRAGLVRAGDAHLSDYR

VHVWKDGFTEALFRFLPDGRLISGNSGNPSVNEFQKAPLSDRDLKKEIKYTDGEESY

NRVRQWLPAMFKYKESDVQRYGLIAQDLARIDPEYVHLLPGYAIYEDVKGVDEEGNE

VVVDRKEIGYTDDVLSLDSNVLLMDLCAAFVHLLHKVEKLEGK

STF-48  (SEQ ID NO: 50)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKAPLDS

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSQLESDADGMGDALVAVKQPYIGSIALTQHDKNTNFISAKDFG

ATADGTLHPLSEKFSTLSAAQAVYPFVTSLTQSLDYAGIQAAINTGRNVLLTSGTYF

VNATIEMNSNCTINGETNSNINRPETFIAVIGNIACFHYHAAFNTINIENVYIFYDG

GRPTSPTGNDKIGILIDGGTTSPGVMHIKNVEVDGAWWAIYDDSGNYLTKYTQVWA

RRVAHGFYKANGTTIQWDTCYVLDAAQAWYVVNCLSPQLINCAGDQITVDGSQYTFD

SSGLYFSGCKCLTITGYDGESNIIKNTNGITASYIKLNDTIAHISGLAGHGNSMQTT

GSGTAAFIFATGTSIVNIKSSTDSFLDSESITYTGSGYPNTLLTDSTAKIIAEGCRF

KAPTGGTPVISTYSTGNGVFTDCSLTGTQTSGSYVESRSSAGNQLPAVYTAKGTQAV

AANVATTLFELPNSQGMYLISVWAESSGTNFSSLQLAMWDGTTLTLTPLKSGGLISF

TVTGRIVTITSQGTTTFNWTYTKAG

STF-49  (SEQ ID NO: 51)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKAPLDS

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSGAIGDGVHDDTSALSELLSVATGGEKIDGRGLTFKVSTLPDV

```
SRFKNARFLFERIPGQPLFYASEDFIQGELFKITDTPWYNAWTQDKTFVYDNVIYAP

FMAGDRHGVNNLHVAWVRSGDDGRTWTTPEWLTDLHENYPTVNYHCMSMGVVRNRLF

AVIETRTVSGNKLQVAELWDRPMSRSLRAYGGITKAANQQVAYIRITDHGLFAGDFV

NFSNSGVTGVTGNMTVTTVIDKNTFTVTTQNTQDVDQNNEGRWSFGTSFHSSPWRKT

SLGTIPSFVDGSTPVTEIHSFATISDNSFAVGYHNGDIGPRELGILYFSDAFGSPGS

FVRRRIPAEYEANASEPCVKYYDGILYLTTRGTLSTQPGSSLHRSSDLGTSWNSLRF

PNNVHHSNLPFAKVGDELIIFGSERAFGEWEGGEPDNRYAGNYPRTFMTRVNVNEWS

LDNVEWVNVTDQIYQGGIVNSAVGVGSVCIKDNWLYYIFGGEDFLNPWSIGDNNRKY

PYVHDGHPADLYCFRVKIKQEEFVSRDFVYGATPNRTLPTFMSTSGVRTVPVPVDFT

DDVAVQSLTVHAGTSGQVRAEVKLEGNYAIIAKKVPSDDVTAQRLIVSGGETTSSAD

GAMITLHGSGSSTPRRAVYNALEHLFENGDVKPYLDNVNALGGPGNRFSTVYLGSNP

VVTSDGTLKTEPVSPDEALLDAWGDVRYIAYKWLNAVAIKGEEGARIHHGVIAQQLR

DVLISHGLMEEESTTCRYAFLCYDDYPAVYDDVITGQREMPLTDNDGSIIVDEDDNP

VMVMEDIIERVEITPAGSRWGVRPDLLFYIEAAWQRREIERIKARLDLIEGKH
```

STF-52 (SEQ ID NO: 52)

```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKAPLDS

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSQLASSEDGMGDALVAVKQPYIGSIALTQHDKNTNFISAKDFG

ATADGTLHPLSEKFSTLSAAQAVYPFVTSLTQSLDYAGIQAAINTGRNVLLTSGTYF

VNATIEMNSNCTINGETNSNINRPETFIAVIGNIACFHYHAAFNTINIENVYIFYDG

GRPTSPTGNDGKIGILIDGGTTSPGVMHIKNVEVDGAWWAIYDDSGNYLTKYTQVWA

RRVAHGFYKANGTTIQWDTCYVLDAAQAWYVVNCLSPQLINCAGDQITVDGSQYTFD

SSGLYFSGCKCLTITGYDGESNIIKNTNGITASYIKLNDTIAHISGLAGHGNSMQTT

GSGTAAFIFATGTSIVNIKSSTDSFLDSESITYTGSGYPNTLLTDSTAKIIAEGCRF

KAPTGGTPVISTYSTGNGVFTDCSLTGTQTSGSYVESRSSAGNQLPAVYTAKGTQAV

AANVATTLFELPNSQGMYLISVWAESSGTNFSSLQLAMWDGTTLTLTPLKSGGLISF

TVTGRIVTITSQGTTTFNWTYTKAG
```

1AR (SEQ ID NO: 53)

```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE
```

-continued

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKAPLDS

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSIATRVSKEGDTMTGKLTLSAGNDALVLTAGEGASSHIRSDVG

GTNNWYIGKGSGDNGLGFYSYITQGGVYITNNGEIALSPQGQGTFNFNRDRLHINGT

QWTAHQGGGWENQWNQEAPIFIDFGNVGNDSYYPIIKGKSGITNEGYISGVDFGMRR

ITNTWAQGIIRVGNQENGSDPQAIYEFHHNGVLYVPNMVKTGARLSAGGGDPVWQGA

CVVIGDNDTGLVHGGDGRINMVANGMHIASWSSAYHLHEGLWDTTGALWTEQGRAII

SFGHLVQQSDAYSTFVRDVYVRSDIRVKKDLVKFENASEKLSKINGYTYMQKRGLDE

EGNQKWEPNAGLIAQEVQAILPELVEGDPDGEALLRLNYNGVIGLNTAAINEHTAEI

AELKSEIEELKKIVKSLLK

1AR-AP1 (SEQ ID NO: 54)

MAVTGPWVGSSAVVNTGQNWMVGAAQRLRMGAPFWMSNMIGRSVEVIHTLGADHNFN

GQWFRDRCFEAGSAPIVFNITGDLVSYSRDVPLFFMYGDTPNEYVQLNIHGVTMYGR

GGNGWAAGAIGASDGGVCIQNDIGGRLRINNGGAIAGGGGGGGYSQANNWAGKYVC

GGGGGRPFGLGGNNGARWPGGNASLTSPGAGGNTGTRYYAGGGGEVGQPGQYANPGA

GYSTPPTSPGAAVAGSAPTWQNVGAIYGPRV

1AR-AP2 (SEQ ID NO: 55)

MSEQTIEQKLSAEIVTLKSRILDTQDQAARLMEESKILQGTLAEIARAVGITGDTIK

VEEIVEAVKNLTAESTDEAKDEE 13-13.0 (SEQ ID NO: 56)

MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASASAAQVAALVTDATDSARAASTSAGQAASSAQEASS

GAEAASAKATEAEKSAAAAESSKNAAATSAGAAKTSETNAAASQQSAATSASTAATK

ASEAATSARDAVASKEAAKSSETNASSSAGRAASSATAAENSARAAKTSETNARSSE

TAAERSASAAADAKTAAAGSASTASTKATEAAGSAVSASQSKSAAEAAAIRAKNSAK

RAEDIASAVALEDADTTRKGIVQLSSATNSTSETLAATPKAVKVVMDETNRKAPLDS

PALTGTPTAPTALRGTNNTQIANTAFVLAAIADVIDASPDALNTLNELAAALGNDPD

FATTMTNALAGKQPKNATLTALAGLSTAKNKLPYFAENDAASLTELTQVGRDILAKN

SVADVLEYLGAGENSITQLEDSQGAHFSTERTLATGAIKTRFFGETFTDGTLYLNQM

NNSSERFSINNWGNSEVGRPAVLEVGDSKGYHFYTERGTDNSLNFDVAGNFTVHGPS

GITIKTSTGARHIWFRDDSDAEKAVIWATDEGILHIRNNYGGSFSHHFQGAMILAGE

RVPYNSEYALIRGNISGGAWVDWRGRPAGLLVDCQDSRNQAYNIWKATHWGDQHLAA

MGVHAGGGNPQVVLHVGGNDYAFASNGDFTAGAAVYCNDVYIRSDRRLKINVKDYEE

NAVDKVNKLKVKTYDKVKSLSDREVIGHEIGIIAQDLQEVLPEAVSTSSVGSQDNPE

EILTISNSAVNALLIKAIQEMSEEIKELKTPLFTKIARKISKYFKF 13-13.0-AP1 (SEQ ID NO: 57)

MAVVGVPGWIGSSAVNETGQRWMSQAAGQLRLGVPCWMSQFAGRSREIIHTLGADHN

FNGQWFRDRCFEAGSTPIVFNITGDLVSYSKDVPLFFMYGDTPNEYVQLNIHGVTMY

-continued

```
GRGGNGGSNSPGSAGGHCIQNDIGGRLRINNGGAIAGGGGGGGGGRYGRLSFGGGGG

RPFGAGGSSSHMSSGATAGTISAPGAGSVGEGSLWVYTGGSGGNVGAAGGRCNIQGN

GTEYDGGAAGYAVIGSAPTWINVGAIYGPRV
```

13-13.0-AP2

(SEQ ID NO: 58)
```
MSEQTIEQKLSAEIVTLKSRILDTQDQAARLMEESKILQGTLAEIARAVGITGDTIK

VEEIVEAVKNLTAESADEAKDEE
```

5. INSERTION POINT SAGDAS
13-14.3

(SEQ ID NO: 59)
```
MAVKISGVLKDGTGKPVQNCTIQLKARRNSTTVVVNTVGSENPDEAGRYSMDVEYGQ

YSVILQVDGFPPSHAGTITVYEDSQPGTLNDFLCAMTEDDARPEVLRRLELMVEEVA

RNASVVAQSTADAKKSAGDASISDDIGWMHYIQRNKDNTVEAVLNGQQTINENIIAK

KDIWVDRAVHTLGEITTNAVNGLRIWNNDYGVIFRRSEGSLHIIPTAFGEGETGDIG

PLRPLSIALDTGKVTIPDLQSSYNTFAANGYIKEVGHGAGAGGYDIQYAQAAPIFQE

IDDDAVSKYYPIVKQKFLNGKSVWSLGTEIESGTFVIEHLKEDSQGHASRFNQDGT

VNFPDNVLVGGDINMKGMMTFDAGRLGSRDYFKENHWGDSNNGRDNIIQLEDSQGAH

FSTERTLATGAIKTRFFGETFTDGTLYLNQMNNSSERFSINNWGNSEVGRPAVLEVG

DSKGYHFYTERGTDNSLNEDVAGNFTVHGPSGITIKTSTGARHIWFRDDSDAEKAVI

WATDEGILHIRNNYGGSFSHHFQGAMILAGERVPYNSEYALIRGNISGGAWVDWRGR

PAGLLVDCQDSRNQAYNIWKATHWGDQHLAAMGVHAGGGNPQVVLHVGGNDYAFASN

GDFTAGAAVYCNDVYIRSDRRLKINVKDYEENAVDKVNKLKVKTYDKVKSLSDREVI

GHEIGIIAQDLQEVLPEAVSTSSVGSQDNPEEILTISNSAVNALLIKAIQEMSEEIK

ELKTPLFTKIARKISKYFKF
```

13-14.3-AP1

(SEQ ID NO: 60)
```
MAVVGVPGWIGSSAVNETGQRWMSQAAGQLRLGVPCWMSQFAGRSREIIHTLGADHN

ENGQWERDRCFEAGSTPIVFNITGDLVSYSKDVPLFFMYGDTPNEYVQLNIHGVTMY

GRGGNGGSNSPGSAGGHCIQNDIGGRLRINNGGAIAGGGGGGGGGRYGRLSFGGGGG

RPFGAGGSSSHMSSGATAGTISAPGAGSVGEGSLWVYTGGSGGNVGAAGGRCNIQGN

GTEYDGGAAGYAVIGSAPTWINVGAIYGPRV
```

13-14.3-AP2

(SEQ ID NO: 61)
```
MSEQTIEQKLSAEIVTLKSRILDTQDQAARLMEESKILQGTLAEIARAVGITGDTIK

VEEIVEAVKNLTAESADEAKDEE
```

Nucleotide Sequences
>STF-25

(SEQ ID NO: 62)
```
ATGGCAGTAAAGATTTCAGGAGTCCTGAAAGACGGCACAGGAAAACCGGTACAGAACTGCACCATTCAGCTGAAAGCCAGAGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAgaaacagcagcggcatcgtccaggaacgcg gcgaaaacatcagagacgaatgcaggtaacagcgcgaaagcggcagcttcttcaaaaacagccgcacaaaacgcagcaacagcg gcagaacgttcagagacaaatgcccgtgcgtcagaagaagcctccgcagacagtgaagaggcttccccgccgtaatgcagagtca gccgctgaaaatgccggagtcgccaccacaaaagcgcgggaggccgcagcagacgcaacaaaggccgggcagaaaaaggatgag
```

-continued gctctgtcggcagcgacacgagctgaaaaggcggcagaccgcgcagaagccgcagcggaagtgactgcagagccctgtgcgaat
atagtgccgccgctgcctgatgtgtggataccgtttaacgattcactggatatgattgcgggttttctccgggctataaaaaa
atagctattggtgacgatgtggttcaggtcgccagtgataaacaggttaatttcagtcgcgcatcaacggcaacatatatcaac
aaatctggcgaactgaaaacggcgaaattaatgagccgcgatttgagtgtgatggcctgatattgagggacaaagaacgaact
acatgctcaattcggaaagtccagccagctgggggaagtcatcaaacatggatgtgcccgaaaccgggacggatagttttggtt
ttacttatggaaagtttgtctgcaacgattctctggttgggcaacttcggctattaatatggcatcaattgctgcaacaaagt
cagttgatgtctcaggcgataacaagtacgtgacaacctcatgccgttttaaaacagaacgacaggtaaggttacgtatacggt
ttgataagtatgatggtagtgcaacaacttttcttggcgatgcgtacattgatacgcaaacgcttgaaattagtatgacaggtg
gtgctgccggcagaattacggcacgagtcaggaaggataagaccacgggctggattttgcagaggcaacgattcaggcaattg
atggtgagttaaaaataggctctcagatacagtattctcctgggcagggtggggcaacagtatctggtgactatatttatcttg
ccaccccacaagtagagaatgggccgtgtgtatcatcatttattatttcaggaggcagcgcaacgacaagagccagtgatttgg
ttagtatccccaccagaaataatctttataagttaccatttacttttttacttgagattcataaaaactgggatattgcaccaa
acgccgcaccccgcgtgtgggatatagcagcagccaataccgggcaatcagcaattgcagcaatcaacagaggtagtggtaagt
tatatatgagtctgtcaaacccttcaggctcgtatgttaatagcgcagcgacagatgtatttgcagagaaaaccacatttggat
gtattgcaaaagctgatggtcactttcatgtggtgacaaatggtaaagcggttaatgaagtttattgtgaatataatggcgtga
ccgctgataaaaatatccgatttggagggcagacgaatactggagaacgacatctgtttggccatattcgcaatttccgcatat
ggcataaagaattaaatgacaggcaattaaaagaggtcgta STF-25-AP1
(SEQ ID NO: 63)
atgaaagatttaactttgaagtttcatgacaaactgcagtttaaggccttcctgtcatctcttggctgggcggaagatgaagac
ctccagaataaactgttagttgatgaaattggtttcacctacacagaaacaggggtaacagaagagggagaacctgtctgtatc
cggaatgatggttattttgtcaacattcgcattcttgatgacttgtttgatgtttctgtattctctgattatgtcgtggagctg
gaaacaccgcttcgggaatggagc STF-27
(SEQ ID NO: 64)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAgaaacggcagcagcctcatcgaagaatgcg
gcgaaaacctcagaaacgaatgcagctaacagcgcacaggcggcagcggcctcgcagactgcatcggcaaactccgcgacagca
gccaaaaaatcagaaaccagcgcgaaaaatagcgagacagccacaaaggccagcgaaaaaaacgcaaaatccagccagacggca
gcgaaaaccagtgagacgaatgccaaagacagtgaagccaacgcaaaggtgagcgaaacagcggcggcgaactcggcgaaagca
tcggcagcaagccagacggcagcaaaagcaagtgaagatgctgccagagaatacgcaaaccagacagcagagccgtacagatat
gttttacagccgctgccggatgtgtggataccctttaatgattcgctggatatgattacgggctattctccgggttataaaaaa
gtgaagattggtgataatgtggttcaggttgccagtgataaacaggttaatttcagtcgcgcatcaacggcaacatatatcaac
aaatctggcgaactgaaaacggcgaaattaatgagccgcgatttgagtgtgatggcctgatattgagggacaaagaacgaact
tatccagaacagtacagacccttcgaagtggaataagtcaacttcactggacgttacagaaacaggcacagatagtttcgggtt
taattatggtcggtttgtcgtacaggattcgattgttggtacaagtaaagcgcataccattatcggactgtattcgagtaccgg
aggggttgatacttcaggggacgaaaagcatgtaactatatcctgtcgggtaaaaagtgaagttgataatatcgccgttcgtat
tttatttgaacattatgatggggaggtaaggacatcaataggagcagcaaacctgaaccttaccacccgcataattagcaagac
aggtcagacaagccgtgttacagcaaggtctgttaaggatgatgcaactggctggatatttttttgaggctacattaaaagcaga
tacaacagaaaatacggttggtggttttgtccagtattctccggatacagggcagatggttacatcagggggattatctcgatgt -continued aaccactccacagattgaggctggtacaggcgcatcatcttttattgttacggggacggcaccggcaacgcgggcaagcgatat ggtgacagtcccaatcaagaataacctttataatcttccttttacggttctttgtgaggtacataagaactggtataaaacgcc aaatgtagcgccgcgtgtttttgataccggcggtcatcaaaccggagcgggatcgtaatggggtttggttcatcaggtgggta cgacggttttccgtattgcgatataggtggttcagaccgacgaataaatgaaatgccgggctggaaaaaatgcttattggtat gcgggtaaagtccgaacggtccacatgtgtagtcagtaacggtaagttaagcagcgaaactaaaaccaaatgggaatatatccg gagtacagcaaccattcgcattggtggacaaactacagcaggattacgccattttatttgggcatgtgaggaattttcgtctctg gcataaagagctaacagatgcgcagcttggggaggttgtggag

STF27-AP1

(SEQ ID NO: 65)

gtgagagatttcacgttgcgtttcagtgataaagcagatttcagggcatttctcaggaaacttaactgggaagaggacgaagag ctgcagaatgccgttctggttgatgagattggttttacgttcagggagacagatgtttctgatgacggagaaccagaatacacg cgaaacgaagggtactttgttaatatccgtatcttgacgatggatttgaggattccgtgttccgtgagtgggtggttacaccag agcgcccgctcagggagtggttt

STF27-AP2

(SEQ ID NO: 66)

atgctgccgcagcatagcgatattgaaatagcctggtatgcttcgatacagcaggagccgaatggctggaagaccgtcaccaca cagttctacatccaggaattcagtgagtatattgcgccactgcaggatgctgtagatctggaaatcgcaacggaggaagaaaga tcgttgctggaggcatggaataaatatcgggtattgttgaatcgtgttgatacatcaactgcacctgatattgagtggccgact tcacctgcagag

STF-28

(SEQ ID NO: 67)

ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAgaaacagcagcggcatcgtccaggaacgcg gcgaaaacatcagagacgaatgcaggtaacagcgcgaaagcggcagcttcttcaaaaacagccgcacaaaacgcagcaacagcg gcagaacgttcagagacaaatgcccgtgcgtcagaagaagcctccgcagacagtgaagaggcttcccgccgtaatgcagagtca gccgctgaaaatgccggagtcgccaccacaaaagcgcgggaggccgcagcagacgcaacaaaggccgggcagaaaaaggatgag gctctgtcggcagcgacacgagctgaaaaggcggcagaccgcgcagaatccgcagcggaagtgactgcagagccctgtgcgaat atagtgccgccgctgcctgatgtgtggataccgtttaacgattcgctggatatgattacgggttttttcgccatcttataaaag attgttattggtgacgatgaaataacaatgccaggcgacaagattgttaagtttaaacgtgcttcaacagcaacgtatattaat aagtccggccaactcaagcttgctgaagttgacgaaccgcgatttgagcgcgatggcttattgattgaaggacagaggacaaat tatctgaggaactcaaataaaccagactcatggactgttcattccgcactgaataaaacatttggcactgataaacaggggttc aattatgccacggtgacacccacggaaagtatagtgggaacaacaggtggctatactgtgcatggtgtggttgcagcagacaga ttcccgctggcaagtggtgaatgtttcactttttcgtgccggggttaaaggcgctaaagcacgatgcaggttaagagtttcagtt attattggtggaacagatacattctctgctgactcttatcttgatctggatacccggatcgcaacagtaagcggtaatacatcc cttataacagccaaagctgaacaacagggcgagtggacctactatgaggccacttatacagctaatacggacattgataccgtt aactgtgctttttatatgacaaataaaataagtaatgagccattctatgatgactcaacattaaccatgacgacgccgcaaatt gaactgggcaatacggcatcgtcatttattgtaactacaatgccaacaacacgcgcaagtgatgtggttactatcccctcggcg aataacctgtcaacacggccttttacagtattgtgcgaagtaaggaggaactggagtacaccgcccaatgttgcgccaaggata tttgatgttggagggcacagtattgatgataattatttatcgctggggtttgtttcaacaggaaagataagcgccaacgtagga atggttcagccacaaatttcctcagatggagaaaggttcattgtgggtgtgagagctaaatctgatttatcagtaaatgcaata

```
tgcaatggtaattatacaacaaaccttaatggtaaaatatttggagttacagcaacatcgtaccggtttggtgggcagaccgca gcaggaacgcgtcatttgtttggacacatcagaaatttcagagtctggtttaaagaattaaatgacaggcaaatcaaggaggca gta
```

STF28-AP1

(SEQ ID NO: 68)
```
atgaaagatttaactttgaaatttcctggtaacagagagtttaaatccttcctgtcatctcttgactgggaggaagatgaagac ctccagaataaactgttagtcgatgaaattggtttcacctacacagaaacaggggtaactgaagagggagaacctgtctgtatc cggaataacggttattttgtcaacattcgcattcttgatgacttgtttgatgtttctgtattctctgattatgtcgtggagctg gaaacaccgcttcgggaatggagc
```

2) INSERTION POINT SASAAA
STF-15

(SEQ ID NO: 69)
```
ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGAACGGAGCGCCTCTGCCGCGGCAgcttctgcaactgcatcagctaacagtcaaaaagca gcaaaaaccagtgaaaccaacgcaaaggtgagcgaaacagcggctgcgaactcagcgaaagcatcggcagcaagccagacggca gctaaagcaagcgaagatgcagccagagagtatgcaagtcaggcagcagagccgtataaatatgtatacagccactgcctgatg tgtggataccgtttaacgattcactggatatgattacgggcttttcgccgtcatataaaaaaattgttattggtgatgatgaaa taacgatgcctggcgacaaggttgttaagtttaaacgcgcatcaactgccacatatatcaataaatcaggcgtatttagtgttg ctaaaattgatgagccacgatttgaaaagaaggtttattgattgaaggacagcgcactaactattttgttaaatccaatactc ccgctgaatggacgagtaccagcaatatcgataaaactaataatggtgttgatgaatttggttttttcatatgccaaaatgcgaa caaaagataatatgacaggacaatcatctgcacttagtctgcatagatgcagtgcatcccggggggattgatgttagtggcgata ataagtattgcactgtttcatgcagggttaaagctcctgatggtcttcgttgtcgtttgcgttttgaaaaatacgatgggtcgg tttatacatttttaggagatgatatttaactttcggaactctgataatagaaaaaactggcggggcagccaatagaatagcagc tactgcaactaaagatccggttacagggtggattttctatgaggcaactatagaagctgttgaaggtgaaaccttaattggcgc aatgattcagtatgcgccgaaaaaaggtggtataactgaagcgggagattatatttaccttgcaacaccacaatttgaaaacgg cggatgtgatcatcttttgttattacgacaactgcacccgcaacccgctccagtgatatggtgacgattccaactaaaaataat atctataatagaccgcttacgtgtatgtcgaggttaatagaatttggggcgatattcctcctaatgtagcaccgcgtattttttg attttctggtgtgccacctattgagtcaattacatacgcttttaacacaactgagaaatattacggtcagattatatgcaaac ttataaagcgtcgacaagtacttacgtttctagtgtgtttgctggtcgagctgatgttcgaaaattcattggtggttttaatat ttattctgatggtactaaacgagtagtttctaacggtgaggctactaaaactatgaaaacggagtggacgggcgtaaaaacacg gacctttattcgaattggaggtcaagccacatcgggaactcgtcatctattcggccatttgagaaatcttcgtctctggcataa agaattaactgatgcgcaaatgggggagagtattaaa
```

STF15-AP1

(SEQ ID NO: 70)
```
atgaaagatttaacactcaaatttgcagacagggccgacttttcggcctttatggagagcattggctattatgatgacgagtcg
```

-continued atgcaggatgatattatattgacgtgataggtaatgtgtacaaagaaaccggagaacttactgaagatggcgagccggcatgtg
ttaaggaggacggatattttgtaaatgtgcgcatcattaatgattcgcaaatatcgtcattattcgatgaacacgcggttgctg
ttgagcatcaactccgtagctggatg

STF15-AP2

(SEQ ID NO: 71)

atggctacatcgacagtaattcctgatgacatcaaaacgctaaagggagatgtcagtaaggcaaaggaagatattcctcaatt
aacgtaaaagtatcaacgcttcagactgatatggacagtgcaaagcaggatatcagtaccagatacacaaaaacagaagtggat
aataagctgaaaaacaaagtggaagtgaacgatctggaaagtggtcgttatggcggagattttttacccgctgactggccgtgaa
gcgtttatttatggggattgggcacaactacagcggcggcaaatctttatcttaatcctgaccctgcaatttcgtctgtgctg
cggtcaacatcgtctatccgctataaacattcagtagagacgatagattcagagcacgccgatctcattttcaggatgcgccct
gtgtggtacaggtcgcaatgcgaaaatgacaggcgtgactgggattctatggattgattgccgaggaagtaggagaaattgcc
cctcagtttgttcactggcgaccagccaacgaagatgatgcaccggaaaccatttccagcaatggccttgttgccgaaggtgta
atgtacgaacgtctggttgttccactgattcaccatatccagaaactgactgaaagagttgatgaacttgagtcagaattgaag
ttgttatcaacttcccaaagcgatatcgga

STF-16

(SEQ ID NO: 72)

ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAgcttctgccactgcatcagccaacagtcaaaaagca
gcaaaaaccagtgaaaccaatgcaaagacaagcgagactgcagcggcgaactcggcgaaagcatccgctgcaagccagaccgct
gcaaaagcaagtgaagacgcagccagagagtatgcaagccaggcagcagatccgtataaatatgtcttacagccgctgcctgat
gtgtggataccgtttaacgattcactggatatgattacgggcttttcgccatcatataaaaagattgttattggtgacgacgaa
ataacgatgcctggcgacaagattgttaagtttaaacgtgcatcgaaagcaacctatattaacaaatctggtgtgctgacagag
gctgccattgatgagccacgatttgaacgtgatggcctgatattgaggggcaaagaactaatcttctgataattcaacaaatcc
atctaaatggaataagtcaggcaatctggaactcacagaaatatccacggattatttaattttacttatgggagatttactgta
aaagatactcttattggtcagacaagtgctattaatatcgtaacgatttctggcagtaaagggtttgatgtcacaggtgatgaa
aaatatgtgaccatttcatgccgtgtaagaagtgatgttgaaaatataaggtgtcgtttaagatttgaacaccatgatggttat
acttacacttttttgggagatgcttacctcaatttatcaacacttgtaattgataaaactggtactgctgcagaccgtattatt
gcaaaggctgtaaaagatgaggttactggttggattttctatcaggctacaattaatgcactagatacagagagcatgattggt
gcgatggttcaatacgctcctgtaaaaggttcaggtacagcatctggagactatctggatatcgcaactccacaagtggaaggt
ggatcaagtgcttcgtcatttattgtaactgatataactgcaagcactcgcgcaagcgatatggtgacagtcccaatcaagaat
aacctttataatcttcctttacggttcttttgtgaggtacataagaactggtataaaacgccaaatgcagcaccgcgtgttttt
gataccggcggtcatcaaaccggagcggctattattcttggcttcggtcgttcaacagattacgacggatttccttattgtgat
ataggtttggctaacagacgggtaaacgaaaacgcatcgcttgaaaaaatggttatggggatgcgtgtaaagtcagatcagtct
acgtgctcagtaagtaacgggcgtatatccagcgaaaagaaagccacatggtcctatattcagaactccgcaattatccgtatt -continued ggaggccagactacagccgggttgcgtcatttatttggtcatgtcaggaatttcagaatatggcacaaggcattgactgatgct cagatgggggagtcaatc

STF16-AP1

(SEQ ID NO: 73)

atgaaagatttaacactcaaatttgcagacagggccgacttttcggcctttatggatagcattggctattatgatgacgagtcg atgcaggatgatattcttattgacgtgataggtaacgtgtacaaagaaaccggagaactgactgaagatggcgaaccggtatgt gttaaggaagatggatattatgtaaacgtgcgcatcattaatgatgcaaaaaaatcgtcaatattcgatgaatacgcggttgta gttgaacatcaacttcgtggctggatg

STF16-AP2

(SEQ ID NO: 74)

atggctacatcgacagtaattccaggagacatcaccacgttaaagggagatgtcagtaaagccaaggaagatatttcctcaatt aacggaaaagtatcaacgcttcaggctgatatgaccagtgcaaagcaggatatcagcaccagatacacaaaaactgaagttgat aataagctgaaaaacaaactggaagtgaacgctctggaaagcggtcgttatggtggagattttttacccgttgactggccgtgaa gcgttttatttgtggggattgggcacgactacagcggcggcaaacctttatcttaatcctgaccccgcaatttcgtctgtgctg cggtcaacatcgtctatccgctataaacattcagtagagacaatagattcagagcacgccgatctcatttttcaggatgcgccct gtgtggtacaggtcacaatgcgaaaatgacaggcgtgactggggattctacggattgattgccgaggaagtaggagaaattgcc cctcagtttgtacactggcgaccagctaacgaagatgatgcaccggaagctatttccagcaatggccttgttgccgaaggtgta atgtacgaacgtctggttgttccactgattcaccatatccagaagctgactgaaagagttgatgaacttgagtcagaattaaag ttgttatccgtttcccgaagcgatatcgga

STF-17

(SEQ ID NO: 75)

ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAgcttctgccactgcatcagccaacagtcaaaaagca gcaaaaaccagtgaaaccaatgcaaagacaagcgagactgcagcggcgaactcggcgaaagcatccgctgcaagccagaccgct gcaaaagcaagtgaagacgcagccagagagtatgcaagccaggcagcagatccgtataaatatgtcttacagccgctgcctgat gtgtggataccgtttaacgattcactggatatgattacgggcttttcgccatcatataaaaagattgttattggtgacgacgaa ataacgatgcctggcgacaagattgttaagtttaaacgtgcatcgaaagcaacctatattaacaaatctggtgtgctgacagag gctgccattgatgagccacgatttgaacgtgatggcctgatattgaggggcaaagaactaatcttctgataattcaacaaatcc atctaaatggaataagtcaggcaatctggaactcacagaaatatccacggattatttaattttacttatgggagatttactgta aaagatactcttattggtcagacaagtgctattaatatcgtaacgatttctggcagtaaagggtttgatgtcacaggtgatgaa aaatatgtgaccatttcatgccgtgtaagaagtgatgttgaaaatataaggtgtcgtttaagatttgaacaccatgatggttat acttacacttttttgggagatgcttacctcaatttatcaacacttgtaattgataaaaactggtactgctgcagaccgtattatt gcaaaggctgtaaaagatgaggttactggttggattttctatcaggctacaattaatgcactagatacagagagcatgattggt gcgatggttcaatacgctcctgtaaaaggttcaggtacagcatctggagactatctggatatcgcaactccacaagtggaaggt -continued ggatcaagtgcttcgtcatttattgtaactgatataactgcaagcactcgcgcaagcgatatggtgacagtcccaatcaagaat
aacctttataatcttccttttacggttctttgtgaggtacataagaactggtataaaacgccaaatgcagcaccgcgtgttttt
gataccggcggtcatcaaaccggagcggctattattcttggcttcggtcgttcaacagattacgacggatttccttattgtgat
ataggtttggctaacagacgggtaaacgaaaacgcatcgcttgaaaaaatggttatggggatgcgtgtaaagtcagatcagtct
acgtgctcagtaagtaacgggcgtatatccagcgaaaagaaagccacatggtcctatattcagaactccgcaattatccgtatt
ggaggccagactacagccgggttgcgtcatttatttggtcatgtcaggaatttcagaatatggcacaaggcattgactgatgct
cagatgggggagtcaatc >STF-17-AP1
(SEQ ID NO: 76)
atgaaagatttaacactcaaatttgcagacagggccgacttttcggcctttatggatagcattggctattatgatgacgagtcg
atgcaggatgatattcttattgacgtgataggtaacgtgtacaaagaaaccggagaactgactgaagatggcgaaccggtatgt
gttaaggaagatggatattatgtaaacgtgcgcatcattaatgatgcaaaaaaatcgtcaatattcgatgaatacgcggttgta
gttgaacatcaacttcgtggctggatg STF-13
(SEQ ID NO: 77)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAtcttctgccactgcatcagccaacagtcaaaaagct
gcaaaaaccagtgaaaccaacgcaaaggcgagcgagactgcggcggctaactcggcgaaagcatccgctgcaagccagacggct
gcaaaagcaagtgaagacgcagccagagagtatgcaagccaggctgcggagccgtataaacaagttttgcagccgcttcccgat
gtgtggataccgtttaacgattcactggatatgatgctggcttttcgcctggttataagcaaataactgtaggtgatgatgtta
ttaaaatgccatccgataaggttgttagcttcaaacgcgcatcaggtgcaacatacattaataaatcaggagtattaaccgttg
ctgaagttgacgaaccgcgatttgaacgagaaggtttgctgattgaaggacaaagaaccaactatcatcttaattcacttacgc
catctaagtggggagctacaacaagtgtaactataacagaaagtggtgttgatgagtttggattacttatgggcggtttcaaat
aaaggacgaaaaaattgggacaaatacgacaatgaatatcgctgcggttcaggaggaagaggtgtcgatgttactggaactga
aaagtatgttacaacatcatgtcgtgtaaaaagcgatagtgctaatatacaatgtcgtataagatttgaaagatatgacgggtc
cgcatatttttatctggcagatgcatatcttaatataacagatatgtccattaggaaaacgggaggagggggctgcaagaataac
cgcccgagcggagaaagaatctaatggatggatttatttcgaggttacatatcaatctgaagctattgataatatggtGtggct
ctcagatccaaattgctccacctgtttcacctggaacttatttgggcggggaatatttggatgttacgacaccacaatttgaag
gcggctcatgcgcatcatctttatcatttccgatacagttgcatcaacgcgagcaagcgatattgttacattgccttgtaaaa
ataacatggccagcaaaccctttaacctgcatggttgaagtgaataaaaattggtctatagcaccaaattccgcgcctagaattt
atgatataacaggatttaaaacaaaagacgacgcttttgttttgcattcagaaatacagcaggtagtgtaggaactccatatg
ttcaatttggtaatccaatatcatttccacctggaaattacccaagaaagattatcgctgtatatagaataaaaagcgatggca
agtttcaggctggctgcaatggggtttatcaacaccagcatcaacaacgtggaagagtgttagtggtgctacaggtataagga
ttggaggccagactacagccggcttacgtcatttatttggttatatcaggaattttagaatatggcataaagaattaaccgatg cgcaaatgggagagataata

STF-13-AP1

(SEQ ID NO: 78)
atgcgagatttaattatcaaattcacagacaaggccgacttttcggcctttatgaagagtgctggctattatgatgacgagtcg atgcaggatgatattcttattgacgtgataggtaacgtgtacaaagaaaccggagaacttactgaagatggcgagccggtatgt gttaaggaagacggatattttgtaaacgtgcgcatcattaatgatgcaaaaaaatcgtcaatattcgataaatacgcggttgtt gttgagcatcaacttcgtggctggatg

STF-13-AP2

(SEQ ID NO: 79)
atggctacatcgacagtaattccaggagatatcaccaagctaaaggggatgtcagtaaagctaaggaagatatttcatcaatt agcagaaaagtatcaacgcttcagactgagatgaccagtgcaaagcaggatatcagctccagatacacaaaaactgaagttgat aataagctgaaaaacaaagtggaagtgaacgatctggaaagtggtcgttatggcggagatttttatccactgacaggtcgtgaa gcgtttatttatggaatttggccacgactacagcggcggcaaacctttatcttaatcctgaccctgcaatttcgtctgtgctg cggtcaacatcgtctatccgctataaacattcagtagagacaatagattcagagcacgccgatctcattttcaggatgcgccct gtgtggtacaggtcgcaatgcgaaaatgacaggcgtgactggggattctacggattgattgccgaggaagtaggagaaattgct cctcagtttgtacactggcgaccagctaacgaagatgatgctcctgaagctatttccagcaatggccttgttgccgaaggtgta atgtacgaacgtctggttgttccactgattcaccatatccagaaactgactgaaagagttgatgaacttgagtcagaattaaag ttgttattaacttcccgaagcgatattaga

STF-12

(SEQ ID NO: 80)
ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAgcttctgccactgcatcagcaaacagtcaaaaagct gcaaaaaccagtgaaaccaatgcaaagacaagcgagactgcagcggcgaactcggcgcaagcatcggcagcaagccagacagca gctaaagcaagtgaggatgcagccagagagtatgcaagccaggcagcagagccgtataaatatgtcttacagccactgcctgat gtgtggataccgtttaacgattcactggatatgatgctggcttttcgcctggttataagcaaataaccgtaggtgatgatgtta ttaaaatgccatccgataaggttgttagcttcaaacgcgcatcaggtgcaacatacattaataaatcaggtgtattaaccgttg ctgaagttgacgaaccgcgatttgaacgagaaggtttgctgattgaaggacagagaacaaactatttcagaaattcaaatacac cagaagcatggaataacacgggtagtgtgtctgttgagtcgttcgacagtgataagggggtttaactatggaaggataactgtta ttaatgaaaatccgacagcacaaggatatcaggcaattgctgtaaacacgaatgatgatacacctgcccggcaggttcttatac gacgatatcgtgtctgacgaaaagtgataattcccggtgtcgtgcaaggttcggaaaaatgtctgataatggtgcgtttgtttt tcattcagatgcagttctggatcctgttacgggaaatgttgttcatggaaataatgtgacggtgacggcagaaagagtcggtga atggtggttgtttaccgccactattttgcagatgcggaaatgataatcagctcaagatttgaaatcctggcgatgcctggaatc agtattatccccaatggctctacgttagatattgcgatgcctcaggcggagattgggtcgtacaggacgtcatttatcattact gaagggggctcctggcactcgctccagcgacatggtgacaatacctgtaagaaacaatattcaccgattaccattcagtgctatg -continued ttgaagttaataaaaactgggatatccctcccagcaaatcaccattaatctttaatgttaaagattatcaggaaaatggtctgt tcacgcatggattccgtggtaataattctctgatgccggttctccttttatttctatgggagggtgtaataaatatgtggcaa caacccagaggaaaatcatttcaggatccgttgtggcgctgatggagatgttcaggccgtatgtaatggtgaattatctgttgc ggcaaaaacaacatggacttcaattgttccacgggcagtattgcgaattggagggcagggcactaatggggagtatcatatttt ggtcatatccgtaatctgcgtatctggcataaagaattaactgatgcgcaaatgggggagagtattaaa

STF-12-AP1

(SEQ ID NO: 81)
atgaaagatttaacactcaaatttgcagacagggccgacttttcggcctttatggagagtattggctattatgatgacgagtcg atgcaggatgatattcttattgacgtgataggtaacgtgtacaaagaaaccggagaactgactgaagatggcgaaccggtatgt gttaaggaagacggatattttgtaaacgtgcgcatcattaatgatgtaaaaaaatcgtcaatattcgataaatacgcggttgtt gttgagcatcaacttcgtggctggatg

STF-12-AP2

(SEQ ID NO: 82)
atggctacatcgacagtaattccaggagatatcaccacgctaaagggagatgtcagtaaaactaaggaagatatttcctcaatt aacgaaaagtatcaacgcttcagactgatatgaccagtgcaaagcaggatatcagcaccagatacacaaaaactgaagttgat aataagctgaaaaacaaactggaagtgaacgatctggaaagcggtcgttatggtggagattttacccgttgactggccgtgaa gcgttttatatgtgggattgggcacgactacagcggcggcaaaccttatcttaatcctgaccctgcaatttcgtctgtactg cggtcaacatcgtctattcgctataaacattcagtagagacgatagattcagagcacgccgatctcattttcaggatgcgccct gtgtggtacaggtcgcaatgcgaaaatgacaggcgtgactggggattctacggattgattgccgaggaagtaggagaaattgcc cctcagtttgtacactggcgaccagctaacgaagatgatgctcctgaagctatttccagcaatggccttgttgccgaaggtgta atgtacgaacgtctggttgttccactgattcaccatatccagaagctgactgaaagagttgatgaacttgagtcagaattaaag ttgttatccgtttcccgaagcgatatcgga

STF-63

(SEQ ID NO: 83)
ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAAATTCCGCGACAGCAGCCAAAAAATCAGAAACCAAC

GCGAAAAATAGTGAGTCAGCAGCAAAGGTCAGCGAAACCAACGCTAAAGCGTCAGAGAACAAGGCGAAAGAATATCTCGACAAG

GTCGGGGGACTCGTCAGCCCGATGACGCAATACGATTGGCCCGTTGTTACTGGTAATGAGTCTTTTTACATAAAGATCGCGAAA

CTTTCCGATCCCGGAAGCAACAATTGCCATGTAACGCTAATGGTTACTAACGGCGGTGACTACGGCTCCCCTTACGGAAACATT

GACTTTATCGAGATCTCGGCGCGCGGTCTGCCTTCTTCGCTTACTGCTGATAATGTATCTCGTTACCTGAGTATACGCCGTTTA

GGGCCAACCGGGCTAATCAATAGCATGCAAATGCGTTACGGCCTGGTTAAAGATGATGGCTTTATTGAGGTTTGGGCCTTCCAG

CGTGCATTTATCAACGGCGCAAAGGTTGCGGTACTGGCGCAGACGGCACGCACGGAATTATACATTCCAGACGGATTTGTTAAG

CAAACCGCCGCGCCTTCTGGATATGTTGAAAGCCCCGTTGTAAGGATTTACGACCAGTTAAACAAGCCGACTAAAGCAGATTTG

GGTCTTTCTAATGCTATGCTTACAGGCGCTTTCGGTCTTGGCGGTAGCGGGATATCAACAAACGGCAAGATGAGCGATGTAGAG

ATCTTAAAAGCTCTGCGTGACAAAGGTGGTCATTTCTGGCGCGGTGATAAGCCGACCGGAAGCACGGCGACCATTTATAGCCAC

-continued

GGTTCTGGTATATTCTCGCGGTGCGGCGATACGTGGTCAGCGATCAATATCGACTACTCAACCGCGAAGATTAAGATCTATGCC

GGCAACGATGCCCGGCTTAACAACGGGACTTTTAGCATCAATGAGCTATACGGCTCGGCAAACAAGCCGTCGAAATCGGATGTT

GGACTTGGCAACGTAACGAACGATGCGCAGGTAAAAAAAACCGGCGATACAATGACCGGTGACTTGACAATCAAAAAAGGTACA

CCGTCAGTCTTCCTGCGGGCAGACAGTGGAGTCACCGCTTTGCGGTTTTATACTGGCGATAACACAGAGCGCGGCATAATCTAT

GCTGGTCCTAACACTGATTCGCTTGGCGAAGTTCGCATCAGGGCAAAGACAGCAGGGGGGACATCAGGAGGGATCTTGTTGTT

CGTCACGACGGGAGGGTTGAAGTCCGTGATCTCACAGTAGCGTATAAAATTAAAAGCAGAACGATTGAGATTGCAAATACCGAT

ACTGACTCATCGGCAACTACGCTCAGCATCTATGGAGTACAGCACACGCCGTTGGTTTTAACGCGTTCTGGTTCTTCTGAAAAT

GTGTCCATTGGGTTTAAGTTAGACAACATGAACCCAAAGTATCTTGGAATTGATACTAATGGGGATCTGGCTTTTGGTGAGAGT

CCTGATCAGAAACAAAACAGCAAATTGATCACGCAAGCGAAACTCGACAAGGGATTAACGATTGGTGGTCAACTGGCTTTCAAA

GGTACGACAGCGTTTTCAGCCGTTGCTACGTTCATTGCCGGGATAGCAGGAGCCATCGAGCCGGAAAACATTGACGGCCAGACG

GTTAATCTTAACAACCTGACCATCATCAAGTCAGATGCCGGGGCAGTTAAATACTATATTTGTCCATCCTCTGCAGGTGGTGCA

AATATTACCAATAAGCCTGACGGCATAGCCGGTAACTTTTTGCTCCGTGTAGAGTCGACTCGTAAGGTTAGGGATTCAGATTAT

GCGAACATGCAAACGCTGATTAACAGCGACACAAAACGTATATACGTTCGCTTTGTTGTTAATGGAAACTGGACAGCGTGGAGT

CAGGTTGTTGTTTCCGGATGGAATCAGGATATAACTGTCAGGTCGTTAACCACATCTAGTCCGGTAAAATCTGGCGGAGGGCGA

ATTGATGTCCTTGGAAGCACGTCAGACTATAGCAAAATGGATTGCTTTGTACGTGGGTTTGATAGCACCGGTAATTCTCTCGCG

TGGGCGTTGGGTTCATCAGCCGGCGTAAGTAAGATGCTGTCGCTAAAAAATTTCTTTAGCGGAGCTGAGATACTGTTAAATGGT

AATGACGGCACGGTTCAACTCAAAACAGGTGCTGTTAACGGGCTACAGCGCAGGCGCTCACTATCAACAGGAATGAGGTTAAC

TCAACTGTTGATTTAACCCTTACAAAACAATCAGGGACTGGCAATCGTTTTGTTTTACAGAACTCAGGTAATGCAGAACTACCG

TTTTCTGTCAGGGTGTGGGGTTCCAGTACTCGACAAAACGTTTTTGAGGTTGGCACGTCTGCTGCGTATCTGTTTTATGCGCAA

AAAACGTCAGCAGGCCAGTTGTTTGATGTAAATGGCGCTATTAATTGCACAACGCTGAATCAGTCATCAGACCGCGACCTTAAA

GACGATATTCTCGTTATCAGCGACGCGACGAAAGCAATCCGTAAAATGAACGGATACACCTACACGCTCAGGGAAAACGGGATG

CCTTATGCTGGCGTTATTGCACAGGAAGTAATGGAGGCGATACCAGAAGCTGTGGGATCGTTTACTCATTATGGTGAAGAGTTG

CAAGGTCCGACCGTTGACGGCAACGAGCTACGCGAAGAAACGCGCTATCTTAATGTTGACTACGCCGCCGTGACGGGCTTACTT

GTTCAGTTCGCCCGTGAAACAGATGATCGCGTTACCGCGCTGGAAGAGGAAAACACAACGCTACGTCAAAATCTGGCAACAGCA

GACACCCGGATCAGCACTCTGGAAAATCAGGTAAGCGAACTGGTTGCACTTGTCCGGCAGTTAACAGGAAGCGAACATTGA

STF-62

(SEQ ID NO: 84)
ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAAACTCCGCGACAGCAGCCAAAAAATCAGAAACCAAC

GCGAAAAATAGTGAGGCAGCAGCAAAGGTCAGCGAAACCAACGCTAAAGCGTCAGAGAACAAGGCGAAAGAATATCTCGACAAG

GTCGGGGGACTCGTCAGCCCGATGACGCAATACGATTGGCCTGTTGTTACTGCTAGTGAGTCTCTTTACATCAAGATCGCGAAA

CTTTCCGATCCTGGAACCAGCAGAAGTCATGTAACGCTAATGGTTACTAACGCTGGTAACTACGGCTCCCCTTACGGAAACATT

```
GACTTTATCGAGATCTCGGCGCGGTCTGCCTTCTTTGCTTAGTGCGGATAATGTTTCTCGTCATCTGAGTATACGCCGCTTA
GGGTCAACCGGGCTGACCGATAACAACCAGATGCGTTACGGCCTGGTTAAAGGTGACGGCTTTATTGAGGTTTGGGCATTCCAG
GGTGCGTTTATTAACGACGCAAAGGTTGCGGTGCTGGCGCAGACAACACTAAACACAGAATTATACATTCCAGACGGATTTGTT
AAGCAAACCGCCGCGCCTTCTGGATATATTGAAGGCAACGTTGTAAGGATTTACGACCAGGTAAACAAGCCGACTAAAGCAGAT
TTGGGTCTTTCTAATGCTATGCTTACAGGCGCTTTCGGTCTTGGCGGTAGCGGGATATCAACAAACGGCAAGATGAGCGATGTA
GAGATCTTAAAAGCTCTGCGTGACAAAGGTGGTCATTTCTGGCGCGGTGATAAGCCGACCGGAAGCACGGCGACCATTTATAGC
CACGGTTCTGGTATATTCTCGCGGTGCGGCGATACGTGGTCAGCGATCAATATCGACTACTCAACCGCGAAGATTAAGATCTAT
GCCGGCAACGATGCCCGGCTTAACAACGGGACTTTTAGCGTCAATGAGCTATACGGCTCGGCAAACAAGCCGTCGAAATCGGAT
GTTGGACTTGGCAACGTAACGAACGATGCGCAGGTGAAAAAATCCGGCGATGTTATGTCTGGTGATCTTGATATATTGAAAGAA
ACGCCATCTATCAGGCTAAAATCAGCAAAAGGAACCGCTCATCTGTGGTTCATGAACAACGACGGAAGCGAGCGCGGCGTTGTT
TGGTCGCCTGAAAACAACGAATCACTTGGCGAAATCCACATCAGGGCGAAAAACACAAAAGGTGAATCAAGTGGTGATTTTATT
GTTCGCCACGACGGGAGGGTTGAGGCCCGCAATCTAAAAATAACTTACAAAATCAGCGCAGCCACCGCAGAATTTGCAAACACA
AGCACCAGTTCCGATAACACTACGGTAAGCATCAAAGGATCTCAGCATACGCCTTTGGTTTTAACGAGCAACAACACAATTAAA
AACTTGTCCATTGGGTTTAAGGTTGATGATGTTGATCAAAAATACCTAGGTATAGCTGGTGACGGTGATTTGTATTTTGGTAGT
TATTCTGACCACACAAAAAACAGCAAAGTAATCACACAAGCAAAACTCGATAGCGGGGTGACGGTAGGCGGTAAAACAACCTTT
TCTGACCTTGCCACATTTAACGCAGGTATGGCGGGATCTATCGAGCCGGAAACCATTGACAACAAGACTATTGATTTAAACGAC
TTGATCATTGCTAATACAGTGGCTGGATCTGTTAAATACTATCAATGCAAAACTGTCGCAGGTGGTGCATATATTACCAATAAG
CCTGACGGCGTAAGCGGTAACTTTTTGCTACGTGTAGAATCTACTCGTAAAACTACGGGTTCAGATTATGCGATCATGCAAACG
CTGATTGGCAGCGACACAAAACGCATATACGTTCGCTTTGTTGTCAATGGAAGTTGGACGGAGTGGAGTCAGGTAGTTGTTTCA
GGATGGAATCAGGATGTAACCGTCAGGTCGTTAACCTCGACGACTCCATCAAAATTAGGCGGCGGGCGTGTTGATGTGCTGGGG
AGTACGTCAGATTACAGTAGTATGAATTGTGCTGTGCGCGGTGTTGATAGCACTGGAACCAATTCGGCGTGGTCAGTAGGTACA
TCGAAAAACACGGGAAAAATGTTGTGCCTTAAAAACCACAGAAGCAGCGCTCAAGTGCTGTTAAATGGCGATGATGGCGCGGTG
CAACTACTAAGCGGTACTGTCAACGGTGCTACAGCACAGGCGCTAACCATCAACAAAGATGAGGTTAACTCAACTGCCGATTTA
GTAATTAGAAAACAAACAGGGACTGGCAATCGTTTTGCTTTACTTAATTCAGGTAATTCAGAACTACCAGTTGGTATCAGGGTG
TGGGGTTCCAGTACTCGTCAAAACGTTTTTGAGGTTGGAACGTCTACTGCGTATCTGTTTTATGCGCAAAAAACGTCAGCAGGC
CAGTTGTTTGATGTAAATGGCGCTATTAATTGCACAACGCTGAATCAGTCATCAGACCGCGACCTTAAAGACGATATTCTCGTT
ATCAGCGACGCGACGAAAGCAATCCGTAAAATGAACGGATACACCTACACGCTCAGGGAAAACGGGATGCCTTATGCTGGCGTT
ATTGCACAGGAAGTAATGGAGGCGATACCAGAAGCTGTGGGATCGTTTACTCATTATGGTGAAGAGTTGCAAGGTCCGACCGTT
GACGGCAACGAGCTACGCGAAGAAACGCGCTATCTTAATGTTGACTACGCCGCCGTGACGGGCTTACTTGTTCAGTTCGCCCGT
GAAACAGATGATCGCGTTACCGCGCTGGAAGAGGAAAACACAACGCTACGTCAAAATCTGGCAACAGCAGACACCCGGATCAGC
ACTCTGGAAAATCAGGTAAGCGAACTGGTTGCACTTGTCCGGCAGTTAACAGGAAGCGAACATTGA
```

STF-71

(SEQ ID NO: 85)
```
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
```

-continued

```
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCATCTTCTGCCACTGCATCAGCCAACAGTCAAAAAGCT
GCAAAAACCAGTGAAACCAACGCAAAGGCGAGCGAGACTGCGGCGGCTAACTCGGCGAAAGCATCCGCTGCAAGCCAGACGGCA
GCTAAAGCAAGTGAAGATGCAGCCAGAGAGTACGCAAGCCAGGCTGCGGAGCCGTATAAACAAGTTTTGCAGCCGCTTCCCGAT
GTGTGGATACCGTTTAACGATTCACTGGATATGATTACGGGCTTTTCGCCGTCATATAAAAGATTGTTATTGGTGATGATGAA
ATAACGATGTCTGGCGATAAGGTTGTAAAGTTTAAACGCGCATCGAAAGCAACCTATATTAATAAATCTGGTGTGCTGACAGAG
GCTGCCATTGACGAGCCACGATTTGAACGTGATGGCCTGCTTATTGAGGGGCAAAGAACAAACTACATGCTCAATTCGGAAAGC
CCTGCCAGTTGGGGGCGATCGTCAAATATGGATGTGCCCGAAACAGGGACGGATAATTTTGGTTTTACCTATGGAAAGTTTGTC
TGCAACGATTCTCTGATTGGGCAAACCTCAGCCATTAATATGGCATCAATTGCTGCAACAAAGTCAGTTGATGTCTCAGGCGAT
AATAAACACGTGACAACCTCATGTCGTTTTAAAACAGAACTGCAGGTAAGGTTGCGTATCCGGTTTGATAAATATGACGGTAGC
GCAACAACTTTTCTTGGTGATGCGTATATTGATACACAAACGCTTGAAATTAATATGACAGGCGGTGCTGCCTCAAGGATTACA
GCGAGAGTCAGAAAGGACGAAGCTACCGGATGGATTTTTGCAGAGGCAACAATTCAGGCAATTGATGGGGAGTTAAAAATAGGT
TCTCAGATACAGTATTCTCCTAAGCAGGGCGGGGCAACCGTATCTGGTGACTATATTTATCTGGCCACCCCACAAGTAGAAAAT
GGGCCTTGTGTATCATCTTTTATTATATCAGGAACGACGGCGGCGACCCGCGCAAGCGATATAGTCACAGTTCCCATTAAGAAT
AATCTTTATAATCTTCCTTTTACGGTTCTTTGTGAGGTACATAAGAACTGGTATAAAACGCCAAATGCAGCGCCGCGTGTTTTT
GACACCGGCGGTCATCAAACCGGAGCGGCAATTATTCTTGGATTCGGTTCTTCAGCAGATTACGACGGATTTCCTTATTGCGAT
ATTGGAGGAGCTAACAGACGGGTAAACGAAAACGCATTGCTTGAAAAAATGGTTATGGGGATGCGTGTAAAGTCAGATCAGTCT
ACGTGCTCAGTAAGTAACGGGCGTATATCCAGCGAAACAAAAACCACATGGTCCTATATTCAGAACACCGCAATTATCCGTATT
GGAGGCCAAACTACAGCCGGGTTACGTCATTTATTTGGTCATGTCAGGAATTTCAGAATATGGCACAAGGCATTGACTGATGCT
CAGGTGGGGGAGTCAATCTAA
```

STF-71-AP1

(SEQ ID NO: 86)
```
ATGAAAGATTTAACACTCAAATTAGCCGACAGGGCCGACTTTTCGGCCTTTATGGAGAGTACTGGCTATTATGATGACGAGTCG
ATGCAGGATGATATTCTTATTGACGTGATAGGTAACGTGTACAAAGAAACCGGAGAACTGAATGAAGATGGCGAACCGGTATGT
GTTAAGGAAGACGGATATTTTGTAAACGTGCGCATCATTAATGATGTGAAAACACCGTCAATATTCGATGAATACGTGGTTGCT
GTTGAGCATCAACTTCGTGGCTGGATGTGA
```

3) INSERTION POINT MDETNR
STF-20

(SEQ ID NO: 87)
```
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
```

-continued

CGTcgtctggcgaaaaatcagaacggtgcagatatccaggataaatcagcttttctggacaatattggtgttaccagcctgacg
tttatgaaaaacaacggcgaaatgccggttgatgctgatctcaatacatttggtccagttaaggcttatgtgggtgtctggtat
aaatccacatcctccaacgcaacactggagaaaaatttccctgaagacggtgcagtcggtgttatgaggtattcaatggcggta
attttccggaatgcagcgttataccaccagaactggcaatgtttatatgcgtaatctttctggcacctggaatggctcagacg
gtccgtggatctactggcgtcagattcagtctgcaacacgcccctgagcacaactattgacctgaacacgctaggaggcgcag
agcatcttggtttatggcgaaacagtagtggctctatcgcttcatttgaccgcaactatccggaagaaggaagttatggtcagg
gattccttgaagttcttgagggtggtgggtactcacgcacgcaacgctatacgacccgccgtgggaacgtatatgttcgctgcc
tttctgctatatggaatgcacagaacccacagtgggagccgtggtcaagagtaggccatcagtcagaatgtcgttattacgaag
gtgatttgaatgatctgacttcgccaggcatttacagcgttacagggaaggcgtcaaacggtccaatgcaggataccgctggag
cgacactgcttggaatactggaagtaatcaggcgttttgatggtgtatctgtctggcagcgttacacaaccacagggaaatcag
aaaccacacaggggcgcacttttgagcgcgtctatgccgggagcaaatggaccgaatggcgagaagtatataactccttttcgt
tgcctctgaatctgggcatcggtggcgcagtggcaaaactatccagtctggactggcagacctacgattttgtgccgggcagtc
tgataaccgttcggcttgataatatgaccaacattcccgacggtatggactggggcgtcattgatggcaacctgataaacatct
cagtcggtccgagtgatgattctggttcggggcgctcaatgcatgtatggcgcagcactgtaagtaaagccaactaccgctttt
ttatggtgcgcatttcaggaaatccgggaagccgcacgatcacaacaagacgagtaccaatcattgacgaagcccagacatggg
gcgcgaaacagacattcagtgctggccttctggtgaactgtccggcaatgcggcgacagcaacaaagctgaaaacagcccgta
aaattaataacgtttcgtttgatggaacatcagatattaacctgacgccgaaaaatattggtgcatttgatcaggaaaaacagg
agacaccgttgcgaatgataaagccgttggatggaactggagtagcggagcctataacgcaactattggtggggcatcaacgtt
aattatcattttaatatcggggaaggaagttgtcccgccgcccagtttcgcgttaattataagaacggtggtatttttttatcgt
tctgctcgtgacggttacggattcgaggctgactggtctgagttttataccacaacgcgaaaacctacagcgggagatgtcggt
gcactgccgttatctggtggtcaattgaatggtgctctgggtataggaacatccagtgctcttggcggtaattcgattgttttg
ggtgataatgacacgggctttaaacaaatggtgatggtaatctggatgtttatgctaatagcgtccatgttatgcgctttgtc
tccggaagcgttcaaagtaataaaaccataaatattacggggcgtgttaatccctcggattacggtaactttgattcccgctat
gtgagagatgtcagacttggcacacgtgttgtccagaccatgcagaaaggggtgatgtatgagaaagcagggcacgtaattacc
gggcttggtattgtcggtgaagtcgatggtgatgaccccgcagtattcagaccaatacaaaaatacatcaatggcacatggtat
aacgtcgcacaggtg

STF-20-AP1

(SEQ ID NO: 88)
atgcagcatttaaaaaatattactgcgggtaatccaaaaactgttgcccaatatcaactgacaaaaaattttgatgttatctgg
ttatggtccgaagagggaaaaaactggtatgaggaagtaagtaattttcaggaagacacgataaagattgtttacgatgagaat
aatataattgtcggcatcaccagagatgcttcaacgctcaaccctgaaggttttagcgttgtcgaggttcctgatattaccgcc
aaccgacgtgctgatgactcaggtaaatggatgtttaaggatggtgccgtgattaagcggatttatacggcagacgaacagctg
caactggcggaattacagaagtcagattgattccgaagctgaaactatcattcagccactggaacgctctgtcagactgaatat
ggcaacagatgatgagcgtagccgactggaagcatgggaacgctacagtgttctggtcagccgtgtggatcctgcaaatcctga
atggccggaaatgccgcaa

STF-23

(SEQ ID NO: 89)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG

-continued

GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
CGTaaagcccattaaacagcccggcgctgaccggaacgccaacaacaccaactgcgcgacagggaacgaataatacccaaatc
gcaagcacggattcgttatggctgcgattgccgcccttgtagattcgtcacctgatgcactgaacacgctgaacgagctggctg
cggcgttgggcaacgacccgaattttgcgaccaccatgactaacgcgcttgcgggtaagcaaccgaaagatgccaccctgacgg
cgctggccgggcttgctactgcggcagacaggtttccgtattttacggggaatgatgtcgccagcctggcaaccctgacaaaag
tcgggcgggatattcttgcgaaatcgaccgttgctgccgttatcgaatacctcggtttacgagaactcggcacaagcggggaga
aaataccgttactcagtacagcgaatacctggaccaatcgacaaacattcagcggtggccttcctggggggactgtccggcaatg
ccgctactgcaacaaagctgaaaacagcacgaaaaattgctggagttggttttgatggttctagcgatatttcaattagtgcca
aaaatgtcaatgcatttgcactccgacaaacaggtaatactgttaatggtgatacatccgttggatggaattgggatagtggtg
catataacgccctgattggtggtgcatctgcattaattatcactttaatataaatgctggtagctgtcctgccgtacaattccg
tgtgaattataaaaatggtggcatttcctacaggtcggctcgtgatggttatgggtttgaattaggttggtcagatttctatac
cacgacacgaaaaccttcagcgggagatgttggtgcatatacgcgggcagaatgtaactcaaggtttattacaggtattcgcct
tggcggtctgtcatctgttcagacatggaatggtcccggctggtctgacaggtcaggttatgtcgttacgggttcagttaacgg
aaaccgtgatgaattaattgatacaacacaggcaaggccaattcagtattgcattaatgggacgtggtataacgcggggagtat
ttaa STF-23-AP1
(SEQ ID NO: 90)
atgatgcacttaaaaaacattactgctggcaaccctaaaacaaaagagcaataccagctaacaaagcaatttaacatcaaatgg
ctttattcagatgatggaaaaaactggtatgaggaacaaaagaatttccagccagacactttgaaaatggtctatgaccataac
ggcgttattatttgtattgaaaaggatgtttcagcaattaatccggaaggcgcaagcgtcgttgaattacctgatattacagca
aatcgccgggctgatatttcggggaaatggttgttcaaagatggcgtagtgataaagcgaacttataccgaggaagagcagagg
caacaagcggaaaatgaaaagcaaagcctgttgcaacttgtcagggataaaacccagctatgggactcacagctacggctgggc
atcatttccgacgagaataaacaaaaattaaccgagtggatgctctatgcgcagaaagtcgaatctacagacacctccagcctg
ccagtaacgtttcccgaacaaccagaa STF-24
(SEQ ID NO: 91)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC -continued GCATCATCAAGTGCCGGTCGTGCAGCTTCCTCGGCAACGGCGGCAGAAAATTCTGCCAGGGCGGCAAAAACGTCCGAGACGAAT GCCAGGTCATCTGAAACAGCAGCGGAACGGAGCGCCTCTGCCGCGGCAGACGCAAAAACAGCGGCGGCGGGGAGTGCGTCAACG GCATCCACGAAGGCGACAGAGGCTGCGGGAAGTGCGGTATCAGCATCGCAGAGCAAAAGTGCGGCAGAAGCGGCGGCAATACGT GCAAAAAATTCGGCAAAACGTGCAGAAGATATAGCTTCAGCTGTCGCGCTTGAGGATGCGGACACAACGAGAAAGGGGATAGTG CAGCTCAGCAGTGCAACCAACAGCACGTCTGAAACGCTTGCTGCAACGCCAAAGGCGGTTAAGGTGGTAATGGATGAGACTAAT CGTcgtatcagaaagatcagaacggtgcggatattcctgataaaagattattcctgcgcaatattggagcaacaaattcaacaa ccatgtcttttagtggtggtacaggatggttcaggctggcaactgtaaccatgccccaggccagttccgtggtttacataagcc tgattggtggtgccggatataatgttaactcccctatgcaggctggtatatctgaacttgttcttcgtgcgggaaatggaaatc caaaaggtcttactggtgcgttatggcgacggacatcggttggatttactaattttgcatgggtgaatacatccggtgatacct atgatgtttatgttgaaataggtaattacgccacaggtgttaatattcagtgggattataccagtaacgccagcgtaacgattc atacatcaccaacttatacagcgaataaaccaacaggcctgacagatggaactgtatatgtaatttacagttcgtacattaaac cgactgctgctgatgttggggcgttatcattatctggtggtcaattgaatggtgctctgggtataggaacatccagtgctcttg gcggtaattcgattgttttgggtgataatgacacgggctttaaacaaaatggtgatggtaatctggatgtttatgctaatagcg tccatgttatgcgctttgtctccggaagcgttcaaagtaataaaaccataaatattacggggcgtgttaatccctcggattacg gtaactttgattccgctatgtgagagatgtcagacttggcacacgtgttgtccagaccatgcagaaaggggtgatgtatgaga aagcagggcacgtaattaccgggcttggtattgtcggtgaagtcgatggtgatgaccccgcagtattcagaccaatacaaaaat acatcaatggcacatggtataacgtcgcacaggtg

STF-24-AP1

(SEQ ID NO: 92)

atgcagcatttaaaaaatattactgcgggtaatccaaaaactgttgcccaatatcaactgacaaaaaattttgatgttatctgg ttatggtccgaagagggaaaaaactggtatgaggaagtaagtaattttcaggaagacacgataaagattgtttacgatgagaat aatataattgtcggcatcaccagagatgcttcaacgctcaaccctgaaggttttagcgttgtcgaggttcctgatattaccgcc aaccgacgtgctgatgactcaggtaaatggatgtttaaggatggtgccgtgattaagcggatttatacggcagacgaacagctg caactggcggaattacagaagtcagattgattccgaagctgaaactatcattcagccactggaacgctctgtcagactgaatat ggcaacagatgaggagcgtagccgactggaagcatgggaacgctacagtgttctggtcagccgtgtggatcctgcaaatcctga atggccggaaatgccgcaataa

O111-2.0

(SEQ ID NO: 93)

ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAGACGCAAAAACAGCGGCGGCGGGGAGTGCGTCAACG

GCATCCACGAAGGCGACAGAGGCTGCGGGAAGTGCGGTATCAGCATCGCAGAGCAAAAGTGCGGCAGAAGCGGCGGCAATACGT

GCAAAAAATTCGGCAAAACGTGCAGAAGATATAGCTTCAGCTGTCGCGCTTGAGGATGCGGACACAACGAGAAAGGGGATAGTG

CAGCTCAGCAGTGCAACCAACAGCACGTCTGAAACGCTTGCTGCAACGCCAAAGGCGGTTAAGGTGGTAATGGATGAGACTAAT

CGTAAGGCTCCTCTGAACTCTCCGGCCCTGACTGGCACGCCTACTACTCCGACTGCGCCGCAAGGGACCAACTCTACCCAGATT
GCGTCCACGGCATTCGTTATGGCTGCTATTGCAGCACTGGTAGATTCCTCGCCGGACGCTCTGAACACTCTGTCGGAACTGGCG
GCTGCACTCGGAAATGATCCGAACTTCGCCACCACCATGACTAACGCTCTGGCCGGCAAACAGCCGAAAGATGCTACCCTGACC
GCCCTGGCAGGTCTCGTGACCGCTGCGGACCGCTTCCCGTATTTCACAGGCAATGACGTTGCCTCCCTGGCTACCCTGACCGAG
GTTGGTCGTGACATCCTGGCGAAGTCTACCGTTGCGGCCGTGATTGAATATCTGGGTCTGCAGGAAACTGTTAACCAGGCATCA
GGTGCATTACAGAAGAATCAAAACGGTGCAGACATTCCGGGCAAAGATACCTTTACCAAGAATATCGGTGCTTGTCGTGCTTAT
TCGGCATGGCTTAATATCGGAGGTGATTCTCAGGTATGGACTACGGCTCAGTTTATCTCTTGGCTCGAGAGTCAGGGTGCGTTT
AATCATCCGTACTGGATGTGCAAAGGCTCTTGGGCGTACGCGAACAACAAAGTCATCACCGACACTGGTTGTGGTAACATCTGT
CTGGCGGGTGCAGTAGTGGAAGTTATCGGTACGCGCGGTGCGATGACGATCCGTGTAACTACTCCATCTACCTCCTCCGGTGGC
GGTATCACCAACGCCCAGTTCACTTACATTAACCACGGCGATGCCTATGCTCCGGGCTGGCGCCGTGATTACAACACTAAAAAC
CAACAACCTGCGTTTGCACTGGGTCAGACGGGTAGTCGTGTGGCGAACGATAAAGCGGTCGGTTGGAATTGGAACTCTGGTGTG
TACAACGCTGATATTAGTGGAGCTTCTACTCTGATCCTTCATTTTAACATGAATGCTGGAAGTTGTCCGGCAGTGCAGTTTCGT
GTTAACTATCGTAATGGAGGAATCTTTTACCGCTCTGCACGTGACGGCTACGGCTTCGAAGCGAACTGGAGTGAATTTTACACG
ACCACTCGTAAGCCGAGTGCTGGAGATGTGGGAGCTTATACTCAGGCAGAATGCAATTCGCGTTTCATTACTGGTATTCGTCTG
GGAGGTTTAAGTTCCGTGCAGACTTGGAACGGTCCAGGTTGGAGTGATCGTAGTGGCTATGTTGTGACAGGCAGTGTTAACGGC
AACCGTGACGAACTGATCGACACTACTCAAGCGCGTCCGATCCAGTACTGCATTAACGGAACTTGGTATAACGCGGGAAGTATC
TAA

O111-2.0-AP1
(SEQ ID NO: 94)
atgatgcacttaaaaaacattactgctggcaaccctaaaacaaaagagcaataccagctaacgaaacaatttaacatcaaatgg
ctttattcagaggatggaaaaaactggtatgaggaacaaaagaatttccagccagacactttgaaaatggtttatgaccataac
ggcgttattatttgtattgaaaaggatgtttcagcaattaatccggaaggcgcaagcgtcgttgaattacctgatattacagca
aatcgccgtgctgacatttcgggtaaatggatgttcaaagatggcgtagtggtaaagcgtacttacacagaagaagagcaacgt
caacaggcgaaaatgaaaagcaaagcctgctacagctcgtcagggataaaacccagctatgggacagtcagctacggctgggc
atcatttccgacgagaataaacaaaaattaacagagtggatgctctttgcgcagaaagtcgaatctacagacacttccagcctg
ccagtaacgtttcccgaacaaccagaatga STF-74
(SEQ ID NO: 95)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
CGTAAATATACGGCTCAGGACGCGAGCACGGCGCAGAAAGGTCTGGTGAAACTGAGCAGCGCCACCGACAGCACATCTGAGACC -continued CTCGCCGCGACACCGAAAGCGGTTAAGGCGGTGAATGATAATGCGAATGGTCGCGTCCCGTCTGAGCGAAAAGTTAACGGACAT
TCGCTGGCCGGTGATATCAGTGTCACCTCACAGGATATTTTTGACGGTCAGTGTGTTGAAATTGGTCCGGGTCAGGATCTGGAT
AATTACCAGACGCCGGGTCTGTATTTTCAGCCCGCAAATGCCAATACCAGTGCTGCTCTGCATTACCCGGAAAATAATGCCGGT
TCCCTGATGGTTTTAAGAAGCGCAGGGATAACGCAGGTTTATCGCGTGTACAGCGGTTCGCGAAGTTATTTGCGGAGCAAATAT
TCCACGCAGCCATGGACGACGTGGACACCCGATGATGCTTTTCCTGTCGGCGCGCCGATTCCGTGGCCATCTGACATCGCCCCG
CCCGCTTACGCCTTAATGCAGGGGCAGTCATTTGATAAATCTGCATATCCATTGCTTGCTGTAGCGTATCCCTCTGGTGTTATC
CCGGATATGCGTGGTCAGACGATAAAGGGCAAGCCGGACGGACGAGCGGTACTCTCGTATGAACAGGACGGTATTAAATCGCAC
GCTCATACAGCCAGTATTTCCGATACCGATTTGGGAACGAAATATACCAACTCTTTTGATTATGGTTCAAAACCAACAACCAGT
TTTGACTACGGCAATAAGTCCTCCACTGAGGGGGATGGCACGTACATAACTTTCGTTATTGTGCTACGTCTGCATACCGGGAT
ACTCCTGGCTCAGGGCTGGGGATGCACTCGTCGAATATTTCGTGGTCAGCCGGGGATCGCATTGAGGGGAGTGGTAATCATGCA
CATGTTACGTGGATTGGTCCCCATGATCACTGGGTTGGTATCGGTGAGCATAACCATTATGTGGTTATGGGGTATCACGGACAT
ACAGCGACCGTTCATGCAACCGGGAATACAGAAAACACCGTTAAAAATATTGCGTTTAACTACATTGTGAGGCTTGCATAA

STF-74-AP1

(SEQ ID NO: 96)
ATGGCTTTTGAAATGACCGGAGAAAACCGGACAATTATTCTTTATAACCTTCGTTCAGATACAAATGAATTTATTGGGAAATCT
GATGGGTTTATCCCTGCTAATACGGGCTTGCCTGCTTACAGTACCGATATCGCGCCCCAAAAGTGACGGCAGGTTTTGTGGCT
GTTTTCGATGCACAGACGAATAAATGGTCGCGGGTGGAGGACTACCGCGGGACAACCGTCTATGACATCAGCACCGGTAAGCCC
GCTGTTATTGAAAAACTTGGCGCTCTGCCTGATAACGTTGTGTCGGTTGCTCCTGACGGGGAGTATGTAAAATGGGATGGCGCT
AAGTGGATCCACGATGCCGAAGCGGAAAAAACATTTCGTCAGGGGCAGGCGGCGCAGGAAAAATCAAACCTGCTGATGATTGCA
ACATCGGCTATTGCCCCCCTGCAGGATGCCGTTGATCTGGATATGGCAACGGAAGACGAAGCGACCGCGCTTAATGAATGGAAA
AAATACCGGGTCATGCTCAACAGAGTCAAACCCGAAGATGCCCCCGATATCACATGGCCGGAACTGCCCGCATAA

STF86

(SEQ ID NO: 97)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAGGGGATAGTG
CAGCTCAGCAGTGCAACCAACAGCACGTCTGAAACGCTTGCTGCAACGCAAAGGCGGTTAAGGTGGTAATGGATGAGACTAAT
CGTCGCGTTCCGGCATCACGAAAGTGAACGGCCATGCCCTGAATGGAGATATCAATGTCACTTCACGGGATATTTTTGACGGC
CAGGTTATAGCGATTGGTGCAAATAAGAATCTGGATGATTACCAGGTACCGGGGCTTTATTTTCAGGAAGCGAACAACAATACC
AGTGCAGCAATGAATTACCCGGAGAATAGCGCGGGTTCTCTGATGGTACTGAGAGGTGCCGGAGTCACTCAGGTTTATCGTGTG
TACAACAGCTCGCGCAGTTATTCGCGCAGCAAGTATTCAACGCTGGCATGGACGCCGTGGATGCCAGAAGATTCTTACCCTGTC
GGCGCACCTATCCCCTGGCCATCGGATGTTACCCCGACAGGGTACGCCTTAATGCAGGGGCAGCCCTTTGATAAAGCGGTCTAT

-continued

CCATTGCTAGCGATTGCCTATCCTGCGGGATTATCCCGGACATGCGAGGCCAGACGATTAAGGGTAAACCGAACGGTCGCGCG
GTACTCTCGTATGAACAGGATGGTGTTATATCGCATACCCACGGAGCCAGTATTTCCGATACCGATTTGGGGACGAAATACACC
AGCTCTTTTGATTATGGTTCAAAACCAACAACCAGTTTTGACTACGGCAATAAATCCTCCACTGAGGGTGGGTGGCACGCACAT
AACTTTCGTTATTGCGCAACGTCTGCATACCGGGATACCCCCGGTCAGGGGCTGGGGATGCATTCGTCTAATGTTTCATGGGCG
GCGGGAGATCGCATTGAGGGAAGCGGTAATCATGCTCATGTGACATGGATCGGCCCTCATGATCACTGGGTGGGTATTGGTGCG
CATAACCATTATGTGGTTATGGGCTATCACGGACATACAGCGACCGTTCATGCCGCAGGAAATGCGGAAAATACCGTTAAAAAT
ATTGCGTTTAACTACATTGTGAGGCTTGCCTGA

STF86-AP1
(SEQ ID NO: 98)
ATGACTTTTGAAATGACCGGAGAAAACCGGACAATTACCATCTATAACCTGCGTGCTGATACAAATGAATTTATCGGGAAAAGT
GATGGGTTTATCCCTGCTAATACCGGTTTGCCTGCTAACAGTACCAATATTGCGCCACCGCCGATGAAAGCCGGTTTTGTCGCT
GTATTTAATTCTGCGTCAGAAAAATGGTCACTTGTTGAAGACCATCGCGGGAAAATTGTTTACGACATTCTCACCGGGAAATCC
ATCACGATTGATGAATTAGGTCAGTTACCTGACGACGTTGTTTCCGTTGCGCCGGAAGGCCATTTTGTTAAATGGAATGGTAAA
AAATGGGTGCATGATGCTGACGCAGAAAAAACGGCACAGATTACACAGGCTACACAGCAAAAAGACAGTCTTCTGGCGCTGGCT
GCATCAAAAATTGCCCCATTACAGGATGCTGTTGATCTGGATATTGCAACGGAAGAGGAAACAGCGCTTTTGCTGGCGTGGAAA
AAATACAGGGTTTTGATTAATCGTATTAAGCCAGAAGATGCGCCAGATATTGACTGGCCGGAGGTTCCGGGCGATGTGGCGTGA

STF84
(SEQ ID NO: 99)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
CGTAAATACACCGCACAGGATGCAACGACAGCACAGAAAGGGATAGTTCAGCTTAGCAACGCGACCAACAGCACATCTGAAATG
CTGGCGGCAACGCCAAAGTCGGTAAAGGCAGCCTATGACCTTGCTAACGGGAAATATACTGCTCAGGACGCTACGACAGCACAA
AAAGGAATTGTCCAGCTCAGTAGTGCAACCAACAGCGCATCTGAAACGCTTGCCGCGACACCGAAAGCAGCTAATGATAATGCG
AATGGTCGGGTACCTTCTGCCCGTAAGGTGAATGGTAAGGCGCTTTCAGCGGATATAACACTGACGCCGAAAGATATTGGTACG
CTTAACTCAACAACAATGTCATTCAGCGGTGGTGCTGGTTGGTTCAAATTAGCAACGGTAACCATGCCACAGGCGAGTTCTGTT
GTTTCAATTACGTTGATTGGTGGCGCGGGATTTAACGTGGGGTCACCTCAACAGGCAGGTATATCTGAACTTGTTTTGCGTGCA
GGTAATGGTAATCCGAAGGGGATTACTGGTGCTTTATGGCAGCGCACATCGACAGGGTTTACAAATTTTGCCTGGGTCAATACA
TCTGGTGATACTTACGATATTTACGTTGCAATCGGAAATTATGCGACTGGTGTAAATATTCAATGGGATTATACCAGTAATGCC
AGCGTGACGATTCATACGTCACCAGCATATTCTGCTAATAAGCCGGAAGGGTTAACGGACGGTACAGTTTATTCACTCTATACG
CCATCAGGGCAGTTTTATCCGCCTGGCGCACCAATCCCGTGGCCATCAGATACCGTTCCGTCTGGTTATGCCCTGATGCAGGGG
CAGACTTTTGACAAATCTGCTTACCCGAAACTCGCAGCCGCTTATCCGTCAGGCGTGATCCCTGATATGCGTGGCTGGACGATT

```
AAGGGCAAACCTGCCAGTGGTCGTGCCGTATTGTCTCAGGAACAGGACGGCATTAAATCGCACACCCACAGCGCCAGCGCATCC

AGTACGGATTTGGGGACGAAAACCACATCGTCGTTTGATTACGGCACTAAATCCACGAATAACACCGGGGCGCATACGCACAGT

GTGAGCGGTACAGCCGCAAGTGCCGGAAACCATACTCATAGTGTCACAGGCGCATCAGCAGTCAGCCAGTGGTCACAAATGGG

TCAGTACATAAGGTAGTGTCTGCGGCCAGTGTGAATACAAGTGCTGCAGGAGCGCACACTCATAGTGTCAGCGGCACAGCCGCA

TCTGCAGGTGCTCACGCACATACTGTCGGTATTGGTGCTCATACGCACTCTGTTGCGATTGGCTCACATGGACACACCATCACC

GTTAACGCTGCTGGTAACGCGGAAAACACCGTCAAAAACATCGCATTTAACTACATTGTGAGGCTTGCATAA
```

STF84-AP1
(SEQ ID NO: 100)
```
ATGGCATTCAGAATGAGTGAACAACCACGGACCATAAAAATTTATAATCTGCTGGCCGGAACTAATGAATTTATTGGTGAAGGT

GACGCATATATTCCGCCTCATACAGGTCTGCCAGCAAACAGTACCTATATTGCACCGCCAGATATTCCTGCTGGCTTTGTGGCC

GTTTTCAACAGTGATGAGGGATCGTGGCATCTCGTTGAAGACCATCGGGGAAAAACCGTCTATGACGTGGCTTCCGGCGACGCG

TTATTTATTTCTGAACTTGGCCCATTACCGGAAAATGTCACCTGGTTATCCCCGGAAGGGGAGTTTCAGAAGTGGAACGGCACA

GCCTGGGTGAAAGATGCAGAAGCAGAAAAACTGTTCCGGATCCGGGAGGCGGAAGAAACAAAAAACAGCCTGATGCAGGTAGCC

AGTGAGCATATTGCGCCACTTCAGGATGCTGTAGATCTGGAAATCGCAACGGAGGAAGAAACCTCATTGCTGGAAGCCTGGAAA

AAGTATCGGGTGTTGCTGAACCGTGTTGATACATCAACTGCACCTGATATTGAGTGGCCTACGAACCCTGTCAGGGAGTAA
```

STF-93
(SEQ ID NO: 101)
```
ATGGCAGTAAAGATTTCAGGAGTCCTGAAAGACGGCACAGGAAAACCGGTACAGAACTGCACCATTCAGCTGAAAGCCAGACGT

AACAGCACCACGGTGGTGGTGAACACGGTGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATCACCGTGTATGAAGATTCACAACCGGGG

ACGCTGAATGATTTTCTCTGTGCCATGACGGAGGATGATGCCCGGCCGGAGGTGCTGCGTCGTCTTGAACTGATGGTGGAAGAG

GTGGCGCGTAACGCGTCCGTGGTGGCACAGAGTACGGCAGACGCGAAGAAATCAGCCGGCGATGCCAGTGCATCAGCTGCTCAG

GTCGCGGCCCTTGTGACTGATGCAACTGACTCAGCACGCGCCGCCAGCACGTCCGCCGGACAGGCTGCATCGTCAGCTCAGGAA

GCGTCCTCCGGCGCAGAAGCGGCATCAGCAAAGGCCACTGAAGCGGAAAAAAGTGCCGCAGCCGCAGAGTCCTCAAAAAACGCG

GCGGCCACCAGTGCCGGTGCGGCGAAAACGTCAGAAACGAATGCTGCAGCGTCACAACAATCAGCCGCCACGTCTGCCTCCACC

GCGGCCACGAAAGCGTCAGAGGCCGCCACTTCAGCACGAGATGCGGTGGCCTCAAAAGAGGCAGCAAAATCATCAGAAACGAAC

GCATCATCAAGTGCCGGTCGTGCAGCTTCCTCGGCAACGGCGGCAGAAAATTCTGCCAGGGCGGCAAAAACGTCCGAGACGAAT

GCCAGGTCATCTGAAACAGCAGCGGAACGGAGCGCCTCTGCCGCGGCAGACGCAAAAACAGCGGCGGCGGGGAGTGCGTCAACG

GCATCCACGAAGGCGACAGAGGCTGCGGGAAGTGCGGTATCAGCATCGCAGAGCAAAAGTGCGGCAGAAGCGGCGGCAATACGT

GCAAAAAATTCGGCAAAACGTGCAGAAGATATAGCTTCAGCTGTCGCGCTTGAGGATGCGGACACAACGAGAAAGGGGATAGTG

CAGCTCAGCAGTGCAACCAACAGCACGTCTGAAACGCTTGCTGCAACGCCAAAGGCGGTTAAGGTGGTAATGGATGAGACTAAT

CGTAGGGTGCCATCTAACCGAAAAGTTAACGGTAAAGCACTGACTGCGGATATCACATTAACGCCGAAAGATATTGGTACTTTA

AATTCAGTAACGATGTCTTTCTCTGGCGGGGCTGGGTGGTTCAAACTGGCTACGGTTACCATGCCACAAGCGAGTTCCATCGTT

TACATCGCATTGATTGGTGGCGCTGGTTACAACGTCGGCTCCCCACATCAGGCAGGCATTTCAGAACTGGTTCTACGAGCAGGC

AATGGAAACCCCAAAGGGATTACCGGTGCTTTGTGGAAGCGTACAGCCGTCGGATTAACGAATTTCGCCTGGATCAACACATCC

GGCGATACATATGATATTTACGTTGAGATTGGCAATTATGCGACTAGTGTAAATATCCATTGGGATTGTACTGCAAATGCGACA

GTTTCTATTTATACATCGCCAACATATTCAGCGAGTAAGCCTTCCAGCGTTACCGATGGTGTTGTTTATACGATGTATAGCACA

CATCAGAAACCGACGCCGTTAGATATTGGAGCACTGCCAACAACCGGAGGAACAGTTTCAGGTCCGTTGTCTGTTACTGGTGGG

ATCACCGGAACATTAAATGGTAATGCAAGTACAGCAACGAAATTGCAGACGCAAGATCTATCGGTGGAGTTGGTTTCGACGGT

TCTGCAAATATCAACCTTCCAGGTGTAAATACTACGGGTAATCAGAACACCACTGGTAATGCTGCAACTGCTACAAAACTTCAG

ACGGCAAGAACTATCGGCGGCGTGAGCTTTGATGGTACTGCGAATATTAATTTGCCAGGTGTTAATACGACTGGTAATCAGAAT

ACAACGGGCAACGCGGCTACTGCTACGAAGTTGCAGACTGCGCGTACTATCAATGGGGTGTCGTTTGACGGCTCGGCAAATATT
```

-continued

TCCTTGTCGCCAGCAAATATAGGTTGCCCGGCATCTCCTACTGGTTGGTTAACTACAGGAAGTAATGGCGGAGCAATAACAACA
GCACAGTTAGTGACGTTATTGCAAAATAATGGAGCATTTAACACAAAGTCATGGATTGCTCGATGTGCGTGGGCCTATGCCAAT
AGTGCAACCATACCAAATAGTGAAACTGGTTGTGGCGTTATTCCATTGGCAGGAGCTGTTATAGAGGTATTTAATAACGGTAGT
AGCTCAAACAATTATACGATCCGTATAACAACGGCCACAACGACGAGTGTCTCTGGTGCTCTCACTAATGCGGAGTTTATCTAT
GTATTTAATGGCACAGATTATTCTCCGGGATGGCGAAGAGTATATAACACGAAAAACAAACCAACAGCCTCTGATGTCGGTGCA
TTACCTCTTACCGGTGGTACATTATCTGGAGGTTTGACATCTTCTGGCGAGATCATTTCAAAATATGCAAATGGTTTCCGCATT
GCTTACGGTAGCTTTGGGTTCTTTATCCGTAATGATGGATCGAACACATATTTCATGCTAACAGCATCAGGAGACACATTAGGT
TCATGGAACGGTTTGCGACCTATTACAATTAATAATACCAGCGGTGCGGTATCAATTGGTAATGGACTAAATGTGACTGGTGGC
GTAAATGGTAGTTTGAACGGTAATGCTTCAACAGCTACGAAGTTGCAAACAGCGAGAAACATCAATGGTGTTAAGTTTGATGGC
TCAGGCGATATCAACATTAATACACTGGTATCTCGTGGCCGAGTTACGGCATTAAGCGGCTCTACTCAAGGCACTGCTGGCATT
CAAATGTACGAGGCGTACAACAATAGCTACCCGACCACGTATGGCAACGTATTGCACATGAAAGGTGCGAGTGCTGCTGGTGAG
GGCGAGTTGCTTATTGGCTGGAGTGGTACGAGCGGTGCACATGCGCCAGTTTTCATTCGCTCACGAAGAGATACCACAGATGCG
GCATGGTCAGCGTGGGCGCAGCTATATACTGCTAAGGATTCAATCCCTGGTGTGAATACAACCGGTAATCAGAATACTACTGGT
AATGCCGCAACAGCCACAAAATTGCAGACAGCAAGGAAAATTGCTGGTGTGGCGTTTGATGGCTCTGCCGATATTACTTTGACT
GCGGCTAACCTTAATGCTTATACGAAAACAGAGGTAACAAACCTTCTAAGTTCCTATGCAAGCAGATCATCACTGACAGGCTAT
AGTGGCAACCTGGATATTATTGCTGAAACACTGGTTGTCAAATCAGGCGGTAGTGGAGGGTTTGCTATATGGGATATTGGCACA
ACTACTAGCGGTGCCAATATGTACATTGATCCAAACCCTGGTATCAATACAGTTTGGCGTTCAACATCTTCAAGGCGCTATAAA
AAGGATATTGAAACATTACAAGATCGATATGCTGATGAACTTTTGTCATTAAGACCTGTTTGGTATCGTTCAATTTGTCGAGGT
GACCGAAAGGATTGGGGGTATTACGGCCTTATTGCTGAAGAGGTTGGTGAGATTGCCCCGCAATATGTCCATTGGCGTGAACCA
ACAAATAATGATTCTCCAGAAGATATTTCCTCAAATGGTATGGTCGCTGAAGGGGTGATGTATGAGCGTTTGGTTGTACCACTC
ATTCATCATATTCAGCAATTGACCAAAAGGGTTGAGGAGCTTGAAACGAAGTTAAATTCACCTAAAGAA
STF-95

(SEQ ID NO: 102)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
CGTCGGGTACCTTCTGCCCGTAAGGTGAATGGTAAGGCGCTTTCAGCGGATATAACACTGACGCCGAAAGATATTGGTACGCTT
AACTCAACAACAATGTCATTCAGCGGTGGTGCTGGTTGGTTCAAATTAGCAACGGTAACCATGCCACAGGCGAGTTCTGTTGTT
TCAATTACGTTGATTGGTGGTGCGGGATTTAACGTGGGGTCACCTCAACAGGCAGGTATATCTGAACTTGTTTTGCGTGCAGGT
AATGGTAATCCGAAGGGGATTACTGGTGCTTTATGGCAGCGCACATCGACAGGGTTTACAAATTTTGCCTGGGTCAATACATCT
GGTGATACTTACGATATTTACGTTGCAATCGGAAATTATGCGACTGGTGTAAATATTCAATGGGATTATACCAGTAATGCCAGC

-continued

GTGACGATTCATACGTCACCAGCATATTCTGCTAATAAGCCGGAAGGGTTAACGGACGGTACAGTTTATTCACTCTATACGCCA
TCAGAGCAGTTTTATCCGCCTGGCGCACCAATCCCGTGGCCATCAGATACCGTTCCGTCTGGCTATGCCCTGATGCAGGGGCAG
ACTTTTGACAAATCTGCATACCCGAAACTTGCAGCCGCTTATCCGTCAGGCGTGATCCCTGATATGCGTGGCTGGACGATTAAG
GGCAAACCCGCCAGTGGTCGTGCCGTATTGTCTCAGGAACAGGACGGCATTAAATCGCACACCCACAGCGCCAGCGCATCCAGT
ACGGATTTGGGGACGAAAAACACATCGTCGTTTGATTACGGAACCAAATCCACGAATAACACCGGGGCGCATACGCACAGTCTG
AGTGGCTCTACGGGGTCTGCCGGTGATCATACTCATGGTAATGGTATTCGTTGGCCAGGAGGCGGCGGTTCTGCGTTAGCATTT
TATGATGGCGGTGGGTTCACTTATGTCCAGGATTCACAGTATCAAGTAAGCCCGGGACTTCTTCCCGTAGATCGTATTATCAA
CGTATTCAGACACAGTCAGCAGGTGCTCATACCCACTCGCTGTCTGGTACTGCAGCAAGTTCTGGCGCACATGCACATACTGTA
GGTATTGGTGCGCATACGCACTCCGTTGCGATTGGTTCACATGGACACACCATCACCGTTAACGCTGCTGGTAACGCGGAAAAC
ACCGTCAAAAACATCGCATTTAACTATATTGTGAGGCTTGCATAA

STF-95-AP1  (SEQ ID NO: 103)
ATGGCATTCAGAATGAGTGAACAAGCACGGACCATAAAAATTTATAATCTGCTGGCCGGAACTAATGAATTTATTGGTGAAGGT
GACGCATATATTCCGCCTCATACAGGTCTGCCAGCAAACAGTACCGATATTGCACCACCAGATATTCCTGCTGGCTTTGTGGCT
GTTTTCAACAGTGATGAGGCATCGTGGCATCTCGTTGAAGACCATCGGGGTAAAACGGTTTATGACGTAGCGTCAGGGGACGAG
TTATTTATTTCTGAACTCGGTCCGTTACCGGAAAATGTTACCTGGTTATCGCCGGAAGGGGAGTTTCAGAAGTGGAACGGCACA
GCCTGGGTGAAGGATACGGAAGCAGAAAAAATGTTCCGGATCCGGGAGGCGGAAGAAACAAAAAACAACCTGATGCAGGTAGCC
AGTGAGCATATTGCGCCGCTTCAGGATGCTGCAGATCTGGAAATTGCAACGGAGGAAGAAACCTCATTGCTGGAAGCCTGGAAA
AAGTATCGGGTGTTGCTGAACCGTGTTGATACATCAACTGCACCTGATATTGAGTGGCCTACGAACCCTGTCAGGGAGTAA

STF-132  (SEQ ID NO: 104)
ATGGCAGTAAAGATTTCAGGAGTCCTGAAAGACGGCACAGGAAAACCGGTACAGAACTGCACCATTCAGCTGAAAGCCAGACGT
AACAGCACCACGGTGGTGGTGAACACGGTGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATCACCGTGTATGAAGATTCACAACCGGGG
ACGCTGAATGATTTTCTCTGTGCCATGACGGAGGATGATGCCCGGCCGGAGGTGCTGCGTCGTCTTGAACTGATGGTGGAAGAG
GTGGCGCGTAACGCGTCCGTGGTGGCACAGAGTACGGCAGACGCGAAGAAATCAGCCGGCGATGCCAGTGCATCAGCTGCTCAG
GTCGCGGCCCTTGTGACTGATGCAACTGACTCAGCACGCGCCGCCAGCACGTCCGCCGGACAGGCTGCATCGTCAGCTCAGGAA
GCGTCCTCCGGCGCAGAAGCGGCATCAGCAAAGGCCACTGAAGCGGAAAAAAGTGCCGCAGCCGCAGAGTCCTCAAAAAACGCG
GCGGCCACCAGTGCCGGTGCGGCGAAAACGTCAGAAACGAATGCTGCAGCGTCACAACAATCAGCCGCCACGTCTGCCTCCACC
GCGGCCACGAAAGCGTCAGAGGCCGCCACTTCAGCACGAGATGCGGTGGCCTCAAAAGAGGCAGCAAAATCATCAGAAACGAAC
GCATCATCAAGTGCCGGTCGTGCAGCTTCCTCGGCAACGGCGGCAGAAAATTCTGCCAGGGCGGCAAAAACGTCCGAGACGAAT
GCCAGGTCATCTGAAACAGCAGCGGAACGGAGCGCCTCTGCCGCGGCAGACGCAAAAACAGCGGCGGCGGGGAGTGCGTCAACG
GCATCCACGAAGGCGACAGAGGCTGCGGGAAGTGCGGTATCAGCATCGCAGAGCAAAGTGCGGCAGAAGCGGCGGCAATACGT
GCAAAAAATTCGGCAAAACGTGCAGAAGATATAGCTTCAGCTGTCGCGCTTGAGGATGCGGACACAACGAGAAAGGGGATAGTG
CAGCTCAGCAGTGCAACCAACAGCACGTCTGAAACGCTTGCTGCAACGCCAAAGGCGGTTAAGGTGGTAATGGATGAGACTAAT
CGTGCCGTTCAGCGTGATGGTGACACCATGACCGGGGAACTGAAAATCCGTGGTGTTAATGCGCTGAGGATTTTCAACGACGCC
TTTGGTCTGATTTTTCGTCGTTCAGAAGAGTGCCTGCACCTTATCCCTACCAGTGAAGGTCAGGGCGAGAATGGCGATATTGGT
CCACTTCGCCCGTTCACTATTAATCTGCGGACGGGTGAAATATCCATGTCGCATAAAGTGTCTGTTGGCGGCGGTTCTCAGGTC
AATGGTGCGCTGGGTATCGGCGTTCAGAACGCGCTGGGCGGAAACTCAATTGCTTTCGGGGATAACGATACAGGTATAAAACAA
AACGGCGACGGCATTCTGGATGTTTATGCGAATGGACAGCACGTATTCCGTTTTCAGAATGGCGCGTTACAAAGTCACCGGGCA
GTGAATGTTTCAGGGCGGGTAACACCAACTGATTATGGCAATTTCGATGAACGCTACCAGACCAAAAACAGGCGGCGTGCAGAAT
TTTCAGTACACCAGTGAGGTGTTTCACAAGCCAGCCGGTAATGAGGTTTCCTGGGTTTTTCGGGCGCCGTCAGGTTGCACTCTT

-continued

```
TCTGGGATTAATGTGCAGGAGACCGGTAGTAACTCTGCGGATAATATCGGTGGTGTGTATTACAAACAGGCCCAGATTTATATA

AATGGCGCATGGCGCTCAGTATCAGGTTAA
```

STF-132-AP1

(SEQ ID NO: 105)
```
ATGGCGCTCAGTATCAGGTTAATTAAGGCAAAAATAATGGAACTCAGAAATGTCACGCGTTATTACCCGGAAAACATGCCTTAT

GGTGAAGGTGTTCAGTATTTCCGTAGTGAAGACGGGCAGGATTTTTATGAATCACTGGATAAATTCGCGAAGAAATACAAGCTG

TGCACGCATCCTGAAACCGGTGTTATTTATTCAATGGCGGAAGACGTATCCCGGCTTTATCCGGCAGGTTTCACCATTGTGGAA

GTGGATGAACTACCGGATGGCTTTTGTATAGAGGCGCGCTGGTATTATAAAGACGGTGAAGTACTGCCGGTTCCTGTTGATTAC

AGACTGCTGGCTGAGTCGGAACGAGCACGTCTTACGGCGATTGCTGAACGGGAAATATCCGACAAGAAAACAGATTTACTTCTG

GGAATAATTAATAATGGGGAAAAAGAAATGCTGAAATTATGGCGGATGTACATCAGAAATTTAAAGAATATTGATTTTAATCAC

ATTCATGATAAATCGTCATTTGATAGTATTAAATGGCCTTGTGATCCTGAGAATTCACATTAA
```

4) INSERTION POINT GAGENS
K1F (SEQ ID NO: 106)
```
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATCTGGACAGT

CCGGCACTGACCGGAACGCCAACAGCACCAACCGCGCTCAGGGGAACAAACAATAC

CCAGATTGCGAACACCGCTTTTGTACTGGCCGCGATTGCAGATGTTATCGACGCGTC

ACCTGACGCACTGAATACGCTGAATGAACTGGCCGCAGCGCTCGGGAATGATCCAG

ATTTTGCTACCACCATGACTAACGCGCTTGCGGGTAAACAACCGAAGAATGCGACA

CTGACGGCGCTGGCAGGGCTTTCCACGGCGAAAAATAAATTACCGTATTTTGCGGAA

AATGATGCCGCCAGCCTGACTGAACTGACTCAGGTTGGCAGGGATATTCTGGCAAA

AAATTCCGTTGCAGATGTTCTTGAATACCTTGGGGCCGGTGAGAATTCGGGTGCGAA

GGGCGATGGCGTTACCGACGACACTGCAGCGCTGACTTCCGCCCTGAACGATACTCC
```

-continued
```
GGTGGGTCAGAAAATCAACGGTAACGGTAAAACTTATAAAGTTACGTCCCTGCCGG

ACATCTCCCGCTTTATCAACACCCGTTTCGTGTATGAACGTATCCCAGGCCAGCCGC

TGTACTACGCATCGGAAGAGTTCGTTCAGGGTGAGCTTTTTAAAATCACCGACACTC

CGTATTATAACGCCTGGCCACAGGATAAGGCTTTCGTGTACGAAAACGTTATCTATG

CTCCGTACATGGGTTCCGACCGTCACGGTGTCAGCCGACTGCACGTAAGCTGGGTGA

AATCGGGCGACGATGGTCAGACCTGGAGCACGCCTGAGTGGCTGACCGACCTTCAT

CCGGACTATCCGACCGTTAACTATCACTGCATGAGCATGGGCGTCTGTCGCAACCGT

CTGTTCGCAATGATCGAAACCCGTACGCTGGCAAAAAACGCTCTGACTAACTGCGCC

CTGTGGGATCGTCCAATGAGCCGCTCTCTGCACCTGACGGGTGGTATTACCAAAGCA

GCGAACCAGCGTTACGCCACCATTCACGTACCGGATCATGGTCTGTTCGTTGGTGAC

TTTGTAAATTTCTCTAATTCTGCAGTTACCGGTGTGTCTGGCGACATGACCGTTGCGA

CCGTAATCGATAAGGACAATTTCACCGTCCTGACCCCGAACCAGCAAACCTCTGATC

TTAACAACGCTGGCAAGAACTGGCACATGGGCACTAGCTTTCACAAATCTCCGTGGC

GTAAAACCGATCTGGGCCTGATCCCGTCTGTAACTGAAGTGCACTCCTTCGCGACCA

TTGATAACAACGGTTTCGCTATGGGTTATCACCAAGGTGATGTTGCACCGCGTGAAG

TCGGCCTCTTTTATTTTCCGGACGCATTCAACAGCCCGTCCAACTACGTGCGCCGTCA

GATTCCGTCTGAATATGAACCGGACGCCTCCGAGCCGTGCATTAAGTACTATGACGG

TGTGCTGTACCTGATTACCCGTGGCACCCGTGGTGATCGTCTGGGTTCATCTCTGCAT

CGCTCCCGCGACATTGGTCAGACGTGGGAAAGTCTGCGCTTCCCGCACAATGTTCAT

CACACCACCCTGCCGTTCGCGAAAGTCGGCGATGACCTGATCATGTTTGGCTCCGAA

CGTGCTGAAAACGAATGGGAAGCGGGCGCCCCAGACGATCGCTACAAGGCATCTTA

CCCGCGCACCTTCTACGCGCGTCTGAACGTGAACAACTGGAACGCAGACGATATCG

AATGGGTAAACATCACCGACCAGATCTACCAGGGTGGTATCGTGAACTCTGGTGTG

GGCGTTGGTTCCGTTGTAGTTAAAGATAACTACATCTATTATATGTTCGGCGGCGAA

GACCACTTCAACCCGTGGACTTACGGCGATAACTCCGCGAAAGACCCGTTCAAATCC

GATGGTCACCCTTCTGACCTCTATTGTTACAAAATGAAAATCGGTCCGGACAACCGT

GTTTCCCGCGATTTTCGCTACGGCGCTGTTCCAAACCGTGCAGTTCCGGTATTCTTCG

ACACGAACGGCGTGCGTACCGTTCCGGCTCCGATGGAATTCACCGGCGACCTGGGT

CTGGGCCACGTAACCATTCGTGCCTCCACCAGCTCTAACATCCGTTCCGAAGTACTC

ATGGAAGGTGAATACGGCTTTATCGGTAAGTCTATCCCGACGGACAACCCGGCAGG

TCAGCGTATCATCTTCTGCGGCGGTGAGGGTACCTCTAGCACCACCGGCGCGCAAAT

CACCCTGTACGGCGCTAACAACACCGACTCTCGTCGTATCGTATACAACGGTGATGA

ACATCTGTTCCAGTCCGCAGACGTGAAACCGTACAACGACAACGTCACCGCACTGG

GTGGTCCATCCAACCGTTTCACCACTGCGTACCTGGGTTCCAACCCGATCGTTACTA

GCAATGGTGAACGCAAAACTGAACCGGTAGTGTTTGACGACGCTTTTCTGGACGCAT

GGGGCGATGTTCATTACATCATGTATCAGTGGCTGGATGCCGTGCAGCTGAAAGGTA

ACGACGCGCGTATCCACTTTGGTGTGATCGCACAGCAGATTCGCGATGTCTTCATCG

CACACGGTCTGATGGATGAAAATAGTACTAACTGTCGCTATGCGGTGCTGTGCTATG

ACAAATACCCGCGTATGACCGACACCGTGTTCTCGCACAATGAGATTGTTGAACATA

CCGATGAAGAAGGTAACGTGACTACTACCGAAGAACCGGTTTATACCGAAGTGGTT

ATTCACGAAGAAGGTGAAGAATGGGGCGTGCGTCCTGATGGTATCTTTTTCGCGGAG
```

-continued

GCAGCGTACCAGCGTCGCAAACTGGAACGCATCGAAGCTCGTCTGTCGGCACTGGA

ACAGAAA

K5

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

AACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGCCTAAAACCGAAGGTATCCTCCATAAAGGTCAGAGCTTATACGA

ATATCTGGATGCCCGTGTTCTTACTTCTAAGCCATTCGGTGCAGCGGGTGATGCAAC

GACCGACGACACGGAGGTTATCGCTGCGAGCCTGAACAGCCAGAAAGCTGTTACCA

TCTCTGACGGCGTTTTCAGTTCTTCTGGCATCAACTCCAACTACTGTAACCTGGATGG

TCGCGGATCCGGTGTGCTCAGCCACCGTAGCTCTACTGGTAATTACCTGGTGTTTAA

CAATCCGCGTACTGGTCGTCTGAGCAATATCACTGTTGAATCTAACAAAGCGACCGA

TACCACTCAGGGCCAACAGGTGTCCCTGGCAGGTGGCAGTGACGTGACCGTGTCAG

ATGTCAACTTCTCCAACGTGAAAGGCACTGGTTTTAGCCTGATTGCCTACCCAAACG

ATGCTCCGCCGGATGGCCTGATGATCAAAGGCATTCGCGGATCTTACAGCGGTTACG (SEQ ID NO: 107)

-continued

CGACCAACAAAGCAGCTGGTTGCGTCCTGGCGGATAGCTCCGTTAACAGCCTGATC
GACAATGTGATCGCTAAGAATTACCCGCAATTCGGTGCTGTTGAATTAAAGGGCACT
GCAAGCTACAACATTGTATCGAACGTTATCGGTGCGGATTGTCAGCACGTGACTTAC
AACGGCACTGAGGGACCGATCGCTCCTAGTAACAATCTGATCAAGGGCGTTATGGC
GAACAACCCGAAATACGCGGCAGTTGTGGCGGGTAAAGGCTCGACGAATCTGATCT
CTGATGTACTGGTAGACTATTCTACCAGCGATGCTCGTCAGGCGCATGGTGTTACCG
TCGAAGGATCTGATAACGTGATTAACAACGTACTGATGTCCGGTTGCGACGGAACTA
ATTCCCTGGGTCAGCGTCAAACCGCAACTATCGCGCGTTTCATCGGTACTGCAAATA
ACAACTATGCTAGCGTGTTCCCATCCTATTCTGCCACTGGTGTGATCACGTTTGAGTC
TGGCAGTACCCGTAACTTCGTCGAGGTTAAGCATCCGGGCCGTCGCAACGATCTTCT
GTCATCGGCAAGCACGATTGACGGCGCTGCGACCATCGACGGGACTTCTAACTCTA
ACGTAGTACACGCGCCTGCTCTGGGCCAATACATTGGCTCCATGAGTGGTCGCTTTG
AATGGCGTATTAAGTCAATGAGCCTGCCGTCCGGCGTACTCACTAGCGCGGATAAAT
ACCGTATGCTGGGTGACGGTGCTGTTAGCCTTGCTGTTGGCGGAGGAACTAGCAGTC
AGGTGCGCTTGTTCACCTCAGACGGTACTTCTCGCACTGTTTCTCTGACCAATGGTAA
CGTGCGCCTGAGCACGTCCTCTACTGGCTATTTACAGCTGGGTGCAGACGCAATGAC
TCCGGACTCCACTGGTACTTACGCGTTAGGCTCCGCATCTCGTGCTTGGAGTGGCGG
ATTCACTCAGGCAGCATTCACCGTTACTTCTGACGCACGTTGCAAAACTGAGCCTTT
AACCATCTCTGACGCTTTACTGGATGCTTGGAGTGAAGTGGACTTTGTCCAGTTCCA
GTATCTGGATCGTGTTGAAGAGAAAGGTGCTGACTCCGCGCGTTGGCATTTCGGAAT
CATCGCCCAGCGTGCTAAAGAGGCATTCGAACGTCACGGCATCGATGCGCATCGTT
ACGGTTTCTTATGCTTTGACTCTTGGGACGATGTGTACGAAGAGGATGCAAATGGAT
CTCGCAAACTGATCACTCCGGCGGGTAGTCGCTATGGTATTCGCTATGAGGAAGTTC
TGATCCTCGAAGCAGCGCTGATGCGTCGCACGATCAAGCGCATGCAGGAAGCACTG
GCTGCGTTACCGAAG

STF-37

(SEQ ID NO: 108)

ATGGCAGTAAAGATTTCAGGAGTCCTGAAAGACGGCACAGGAAAACCGGTACAGAA
CTGCACCATTCAGCTGAAAGCCAGACGTAACAGCACCACGGTGGTGGTGAACACGG
TGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATC
ACCGTGTATGAAGATTCACAACCGGGGACGCTGAATGATTTTCTCTGTGCCATGACG
GAGGATGATGCCCGGCCGGAGGTGCTGCGTCGTCTTGAACTGATGGTGGAAGAGGT
GGCGCGTAACGCGTCCGTGGTGGCACAGAGTACGGCAGACGCGAAGAAATCAGCCG
GCGATGCCAGTGCATCAGCTGCTCAGGTCGCGGCCCTTGTGACTGATGCAACTGACT
CAGCACGCGCCGCCAGCACGTCCGCCGGACAGGCTGCATCGTCAGCTCAGGAAGCG
TCCTCCGGCGCAGAAGCGGCATCAGCAAAGGCCACTGAAGCGGAAAAAAGTGCCGC
AGCCGCAGAGTCCTCAAAAAACGCGGCGGCCACCAGTGCCGGTGCGGCGAAAACGT
CAGAAACGAATGCTGCAGCGTCACAACAATCAGCCGCCACGTCTGCCTCCACCGCG
GCCACGAAAGCGTCAGAGGCCGCCACTTCAGCACGAGATGCGGTGGCCTCAAAAGA
GGCAGCAAAATCATCAGAAACGAACGCATCATCAAGTGCCGGTCGTGCAGCTTCCT
CGGCAACGGCGGCAGAAAATTCTGCCAGGGCGGCAAAAACGTCCGAGACGAATGC

```
CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

AACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGGAGTTATCTGGAGAGCACGGGTCGTTTTTGATTGGCGGAGTAATT

GATTGTTACTCAACCGTTTCAGATCTTATTTCTTCCTCCCCATCCGTTGGTAGAGTAT

GCAGGACTATAGGGTATTACAGCCCAGGTGATGGAGGTGGGGCAGATTACATAATT

AGTATTGGAACTCCGATGCAAGATTTTAGCGATTCTGGTTCTATAGTTATAGATGAA

TGCAAGTTCGCTAAATTAATCCAGCAAAGCCAATATGATTTAAAGCAGTTTGGAGTA

AAACCATCTGACCCGTCTTATGCAGAAAAAAACGACATATTTATCTCGCAAGCCATT

ACTAGGTCTAGAGTTGGAAGATGCAAGATTATTATAAGCGATGTTATATATCATAAA

AAACCTTTAATTTTTGATTATTACAATCATATGGAAGGAAGTTGTATTGGTAGTGAC

CCGGAATTTACTCCTAGGTTTATAAAAATAGATAATACAACTAGCGGTTTGCCAGAT

ATGGGATACCCTGGTGTTGCTGATGTTGTATCTTACGATGTTGATGCAGGAATAATA

ATTAAAAGACAGAATTCTGGCACAAGTTTTGCCAGAGGTTTCATAATTAAGGGGTTT

CTTCTTCAGTCGGAGAAGAAATCAGCATGGGCAATTTACGCGCCGCATATGGCGGAT

TTTGATATAGACATTGATAGTCGTGGGTTTAATGGAGGAATCAGATGGTTTGTTAAT

TTTCTTGGAAGAATGGCAGGAAGACATATAGGTCTTGGTGCAAACTCATCAGATCCA

ACATTATCTATAGGTGCGTGGTGTTCGAAATTCTCTACAATACCTGATTGTGGTAATT

CCGTTGTATTCAGATTGTCATTCAATGGATTTAACAGAGGTATGCAAATGGAGTATT

TTGGTAATGGGGTTTTAGATAGAGTAACTCTTGAAAATATTTCAAAACCAACACCTA

CGTCGCCAACAACACATGGAATATATGCAACTGATACATGGTTAACTGGCCAGGTGT

CATGTGAAAGTTCTTCAACCTGCATCATCCGTGCTGGCAATAACGCGAACTTCGATA

TTACCCTTAGTGCGGTATTCCATGTTACGCAAGATGATCCTTCCGAGGGTATTGTTCA

TGTATTAAATGGAGGCCGCCTAACTCTGCGTTCATCTACAATTCTTGCTGATTTGGCA

GATACAAAAATCATTAATGAGAATGGAGGTTATCTCGATATTGCCGCAAATACCAG

AACAGGAAATATTGTTTATTCCAATAGTGATAATTACAGATTCAAAGACAGAACCAT

TGGTTTTGGTCAGACTGCGGCAACTACAAAAACAAGCTTCTCTTCTGGTGAAGAGAT

TACATTTTCACTACTAAACGGAACGCCAAAAGCGAATCTATCTGGCGGAACGATCCA

GTTTAACTCTCCATGCCTGATTAAAATCACTGTGCAGGGGAGGGGTATAACATCAGG

AGCACTTACTTTTGGGATAAATGGAGAATCTTCAGAGAGCGTGAGTCAGGGACAGC
```

-continued

AGGTTTCTATGGTTGTCGGAGTGGTATCCGGTGACATTCTTAACCTGAAGGCAACCT
CATCACTGACGCTGGGTAGTGCAGGAGGGGTGCGGGTACTTCTTGAGCCTGTAAAC
1JL (SEQ ID NO: 109)

ATGGCAGTAAAGATTTCAGGAGTCCTGAAAGACGGCACAGGAAAACCGGTACAGAA
CTGCACCATTCAGCTGAAAGCCAGACGTAACAGCACCACGGTGGTGGTGAACACGG
TGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATC
ACCGTGTATGAAGATTCACAACCGGGGACGCTGAATGATTTTCTCTGTGCCATGACG
GAGGATGATGCCCGGCCGGAGGTGCTGCGTCGTCTTGAACTGATGGTGGAAGAGGT
GGCGCGTAACGCGTCCGTGGTGGCACAGAGTACGGCAGACGCGAAGAAATCAGCCG
GCGATGCCAGTGCATCAGCTGCTCAGGTCGCGGCCCTTGTGACTGATGCAACTGACT
CAGCACGCGCCGCCAGCACGTCCGCCGGACAGGCTGCATCGTCAGCTCAGGAAGCG
TCCTCCGGCGCAGAAGCGGCATCAGCAAAGGCCACTGAAGCGGAAAAAAGTGCCGC
AGCCGCAGAGTCCTCAAAAAACGCGGCGGCCACCAGTGCCGGTGCGGCGAAAACGT
CAGAAACGAATGCTGCAGCGTCACAACAATCAGCCGCCACGTCTGCCTCCACCGCG
GCCACGAAAGCGTCAGAGGCCGCCACTTCAGCACGAGATGCGGTGGCCTCAAAAGA
GGCAGCAAAATCATCAGAAACGAACGCATCATCAAGTGCCGGTCGTGCAGCTTCCT
CGGCAACGGCGGCAGAAAATTCTGCCAGGGCGGCAAAAACGTCCGAGACGAATGC
CAGGTCATCTGAAACAGCAGCGGAACGGAGCGCCTCTGCCGCGGCAGACGCAAAAA
CAGCGGCGGCGGGGAGTGCGTCAACGGCATCCACGAAGGCGACAGAGGCTGCGGG
AAGTGCGGTATCAGCATCGCAGAGCAAAAGTGCGGCAGAAGCGGCGGCAATACGTG
CAAAAAATTCGGCAAAACGTGCAGAAGATATAGCTTCAGCTGTCGCGCTTGAGGAT
GCGGACACAACGAGAAAGGGGATAGTGCAGCTCAGCAGTGCAACCAACAGCACGT
CTGAAACGCTTGCTGCAACGCCAAAGGCGGTTAAGGTGGTAATGGATGAGACTAAT
CGTAAGGCACCTCTGGACAGTCCGGCACTGACCGGAACGCCAACAGCACCAACCGC
GCTCAGGGGAACAAACAATACCCAGATTGCGAACACCGCTTTTGTACTGGCCGCGA
TTGCAGATGTTATCGACGCGTCACCTGACGCACTGAATACGCTGAATGAACTGGCCG
CAGCGCTCGGGAATGATCCAGATTTTGCTACCACCATGACTAACGCGCTTGCGGGTA
AACAACCGAAGAATGCGACACTGACGCGCTGGCAGGGCTTTCCACGGCGAAAAAT
AAATTACCGTATTTTGCGGAAAATGATGCCGCCAGCCTGACTGAACTGACTCAGGTT
GGCAGGGATATTCTGGCAAAAAATTCCGTTGCAGATGTTCTTGAATACCTTGGGGCC
GGTGAGAATTCGggctacaaagttcagagcttagcaattctgtccgacacccaagctgtccacgatgctactaacaccattaaaac
ccagacggacaagatcaaggcagacacgcaggcaatcaaaactcaaacaaatcaaattaaaaccgaaacgggcgtaattcgtgata
aagcgaacactgcgaaaactgatgcgcaggccgcgagcgccgccgcacaaggcttccgtgatcaggcgaaggagtgggcacaaagt
gtaaacgctgataacttattaaccaaaacgggcaacttagctggcctgactgacaagagcgcggcacgttctaatttagggctagg
AAGCGTAGCAACGGAAAACACCGTTCCAATTAAGAAAGGCGGCACTgcggcaacgaccgtcgcggcggcacgctccaatttagggc
tgggtagcgttgcaacggagaacactgtcccaattgaaaagggggggactgcggcgacaaccgccgcgaaagcgcgtagcaatctg
ggtttaggtagcgtagctacggagaataccgtgccgattgaaaagggcggcacggcggcgaccactgccgctaaagcccgttcgaa
cttcggcttaggcgataacaacaaagtaaaacttggtacactgcgcctgaacgggggtgaatctctggttttcaacgatgtggaac
gcaatggcctgattatcagcaacgccagatcggtatcgatagctgggttggtcaaaccatgcacaaatggtataccgattggacgc
gtgctggcttagtgcgtgcaggtgacgcgcatctgagcgattatcgtgtgcatgtttggaaagacggtttcaccgaagccctgttt -continued cgtttcctgccggacgggcgcttgatttccggcaactccggtaatccgtctgttaacgaatttcaaaaagccccgctgtctgatcg tgacctgaaaaaagaaatcaagtacactgatggcgaagaatcctataaccgtgttcgccaatggcttccggctatgttcaaataca aagagagcgacgttcagcgttacggcctgattgcacaagatctggcacgtattgatccggaatacgttcacttattaccgggctat gcaatctacgaagacgttaagggtgtagacgaagagggcaatgaggttgttgtggatcgtaaagagatcggctataccgacgatgt gttatctctggattctaacgtcttattaatggatttatgcgcggcattcgtgcatttattacataaagttgaaaaattggaaggca aa

STF-48

(SEQ ID NO: 110)

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

AACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGCAGTTAGAAAGCGATGCTGATGGAATGGGAGATGCACTAGTTGC

AGTTAAGCAGCCATATATCGGCTCAATAGCTTTAACTCAACATGATAAAAATACCAA

CTTCATTTCAGCCAAGGATTTCGGTGCAACAGCTGACGGAACTCTGCATCCACTCAG

CGAGAAATTCTCCACACTATCAGCGGCGCAGGCTGTTTATCCATTCGTAACATCACT

AACTCAGTCTCTTGACTATGCAGGCATACAGGCCGCAATTAATACAGGGCGGAATGT

-continued

ATTATTGACATCTGGAACTTACTTCGTAAATGCAACGATAGAGATGAATTCAAACTG

CACAATAAATGGCGAAACAAACAGCAACATAAATAGGCCGGAAACTTTCATAGCAG

TAATAGGAAATATAGCTTGTTTCCATTACCACGCAGCGTTTAATACAATAAATATTG

AAAATGTCTATATTTTTTACGATGGAGGACGCCCTACATCACCTACTGGCAATGATG

GTAAAATTGGCATTCTAATTGATGGAGGAACTACTTCACCAGGCGTTATGCACATTA

AAAATGTTGAGGTTGATGGTGCATGGTGGGCCATATATGATGACTCTGGAAATTACC

TAACAAAGTATACCCAGGTATGGGCGAGGAGAGTTGCGCATGGTTTCTATAAGGCG

AACGGAACGACAATACAGTGGGATACATGTTATGTGCTGGATGCAGCACAGGCATG

GTATGTTGTAAATTGCCTGTCTCCTCAGCTAATAAACTGTGCAGGAGACCAGATCAC

AGTTGACGGGTCGCAATATACATTTGATTCCTCAGGGTTATATTTTTCTGGATGTAAG

TGTCTTACTATTACAGGGTATGATGGTGAGTCTAATATAATAAAAAATACAAATGGA

ATTACTGCGTCGTATATAAAACTTAATGATACTATTGCCCATATATCAGGATTGGCC

GGGCATGGAAACTCAATGCAAACAACGGGGAGTGGGACAGCAGCATTTATCTTTGC

AACAGGCACAAGCATTGTTAACATAAAATCAAGTACCGATAGCTTCCTTGATAGCG

AATCAATAACCTACACTGGCTCTGGATACCCAAACACATTGCTGACAGACTCAACA

GCAAAAATAATTGCTGAGGGATGCCGGTTTAAGGCTCCGACTGGTGGGACTCCTGTA

ATATCAACTTACAGCACAGGGAATGGAGTATTTACTGACTGCTCATTAACTGGGACG

CAAACTTCAGGCTCATATGTTGAATCACGAAGCTCTGCAGGTAATCAGTTGCCAGCA

GTGTACACAGCGAAAGGAACTCAGGCTGTTGCAGCTAACGTAGCAACTACGTTGTTT

GAACTGCCAAATAGCCAAGGGATGTACCTGATAAGCGTTTGGGCAGAAAGCAGTGG

AACAAATTTCTCTTCGCTTCAGCTTGCCATGTGGGACGGAACAACACTTACTTTAAC

TCCGCTTAAGTCAGGAGGGTTGATATCATTTACAGTGACAGGAAGGATTGTAACCAT

CACAAGCCAGGGAACAACAACATTTAACTGGACATACACCAAGGCAGGG

STF-49 (SEQ ID NO: 111)

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

```
AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

AACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGGGGGCTATTGGTGATGGTGTTCATGATGATACATCAGCTCTATCA

GAATTACTTTCTGTTGCAACAGGTGGTGAAAAGATAGATGGGCGAGGGCTTACTTTT

AAAGTATCAACTCTTCCAGATGTCAGTCGATTTAAAAATGCTCGTTTTTATTTGAGA

GAATACCGGGTCAGCCTCTTTTTTATGCTTCTGAAGATTTTATCCAGGGAGAGTTATT

TAAAATTACAGATACACCGTGGTACAACGCCTGGACGCAGGATAAAACGTTTGTAT

ATGACAATGTCATCTATGCGCCTTTTATGGCTGGAGACCGCCATGGTGTAAATAACC

TCCATGTTGCATGGGTTCGCTCAGGAGATGACGGGAGGACCTGGACAACGCCGGAA

TGGCTTACAGATTTACATGAAAACTATCCCACAGTTAACTATCACTGCATGAGTATG

GGGGTTGTCAGAAATCGCCTTTTTGCTGTAATTGAGACGCGGACCGTGAGCGGAAAT

AAACTGCAGGTTGCAGAGTTGTGGGATCGCCCAATGAGTCGCAGCCTTCGCGCTTAT

GGTGGTATAACGAAAGCAGCAAATCAGCAAGTCGCTTATATTCGCATTACTGATCAC

GGATTATTTGCTGGTGATTTTGTCAACTTCTCAAACTCTGGTGTTACAGGTGTTACCG

GGAATATGACGGTGACTACTGTTATTGATAAAAATACTTTTACAGTTACGACGCAAA

ATACCCAGGATGTGGATCAGAATAACGAGGGTAGATACTGGAGTTTTGGTACATCA

TTTCACTCGTCACCATGGAGAAAAACCAGTCTTGGAACTATTCCTTCTTTTGTTGACG

GAAGCACTCCTGTTACTGAGATTCACAGTTTTGCGACGATTAGCGATAACAGTTTTG

CTGTTGGCTACCATAATGGTGATATTGGTCCACGCGAGCTTGGGATACTCTATTTCTC

TGATGCTTTCGGTTCTCCTGGTAGCTTTGTTCGCAGACGCATACCTGCAGAATATGA

GGCGAATGCATCTGAGCCATGTGTAAAATATTATGATGGCATTCTGTATCTGACGAC

CAGGGGGACATTAAGTACTCAACCCGGTAGTTCATTGCACAGAAGCTCTGATTTAGG

TACATCATGGAATTCTCTTCGCTTCCCAAATAATGTTCATCACTCAAACCTTCCTTTT

GCCAAAGTTGGCGATGAGCTGATTATTTTTGGCAGTGAGCGCGCATTTGGTGAGTGG

GAAGGAGGAGAACCTGATAACCGTTATGCAGGAAACTATCCAAGAACATTTATGAC

CAGAGTTAACGTCAATGAGTGGAGTCTGGATAATGTAGAGTGGGTTAATGTTACTGA

TCAGATTTATCAGGGCGGAATAGTTAACTCTGCGGTTGGTGTTGGTTCAGTTTGTATC

AAAGACAACTGGCTGTACTACATTTTCGGTGGGGAAGACTTTCTAAACCCATGGAGC

ATAGGGGATAACAACAGAAAATATCCTTATGTTCACGATGGTCACCCGGCTGATTTG

TATTGTTTCAGGGTGAAAATTAAACAGGAAGAATTTGTTTCAAGGGATTTTGTCTAC

GGAGCCACTCCTAACAGAACGCTTCCTACTTTTATGTCGACGTCAGGCGTGAGGACG
```

-continued

GTTCCTGTACCCGTTGATTTCACAGATGATGTTGCCGTCCAGTCACTGACTGTCCATG

CAGGTACATCAGGACAAGTTCGCGCGGAAGTCAAACTTGAGGGTAATTACGCCATT

ATTGCGAAGAAAGTACCGTCTGATGATGTTACCGCTCAGAGATTAATCGTTAGCGGC

GGTGAAACAACGTCTTCAGCAGATGGTGCAATGATAACGTTGCATGGTTCCGGAAG

CAGTACTCCTCGTCGCGCGGTATATAACGCACTCGAACATCTTTTTGAGAACGGAGA

TGTTAAACCTTATCTTGATAATGTAAATGCTCTTGGTGGTCCGGGAAACAGGTTCTC

GACAGTTTATCTTGGCTCCAATCCTGTGGTTACCAGTGACGGAACATTAAAGACAGA

GCCGGTCTCTCCTGACGAAGCATTGCTGGATGCCTGGGGTGACGTCAGGTATATCGC

TTATAAATGGCTGAACGCTGTCGCTATAAAGGGGGAAGAAGGGGCGAGGATACATC

ATGGTGTAATCGCGCAGCAACTTCGTGATGTTCTTATTTCTCACGGACTCATGGAAG

AAGAAAGCACAACATGCCGCTATGCGTTTCTTTGCTATGACGATTATCCCGCAGTAT

ATGATGACGTCATTACTGGCCAAAGGGAAATGCCGCTGACTGATAATGACGGGAGC

ATCATTGTTGATGAGGATGATAATCCAGTGATGGTAATGGAAGACATCATTGAGCGC

GTTGAAATAACGCCAGCAGGATCTAGATGGGGGGTCAGACCTGATCTCTTATTCTAT

ATCGAGGCGGCATGGCAGCGCAGAGAAATAGAAAGAATAAAAGCTAGGTTAGACTT

AATAGAAGGGAAGCAC

STF-52

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG (SEQ ID NO: 112)

-continued

```
CAGCGCTCGGGAATGATCCAGATTTTGCTACCACCATGACTAACGCGCTTGCGGGTA
AACAACCGAAGAATGCGACACTGACGGCGCTGGCAGGGCTTTCCACGGCGAAAAAT
AAATTACCGTATTTTGCGGAAAATGATGCCGCCAGCCTGACTGAACTGACTCAGGTT
GGCAGGGATATTCTGGCAAAAAATTCCGTTGCAGATGTTCTTGAATACCTTGGGGCC
GGTGAGAATTCGCAGCTAGCAAGCTCAGAAGATGGAATGGGTGACGCACTAGTTGC
AGTTAAGCAGCCATATATCGGCTCAATAGCTTTAACTCAACATGATAAAAATACCAA
CTTCATTTCAGCCAAGGATTTCGGTGCAACAGCTGACGGAACTCTGCATCCACTCAG
CGAGAAATTCTCCACACTATCAGCGGCGCAGGCTGTTTATCCATTCGTAACATCACT
AACTCAGTCTCTTGACTATGCAGGCATACAGGCCGCAATTAATACAGGGCGGAATGT
ATTATTGACATCTGGAACTTACTTCGTAAATGCAACGATAGAGATGAATTCAAACTG
CACAATAAATGGCGAAACAAACAGCAACATAAATAGGCCGGAAACTTTCATAGCAG
TAATAGGAAATATAGCTTGTTTCCATTACCACGCAGCGTTTAATACAATAAATATTG
AAAATGTCTATATTTTTTACGATGGAGGACGCCCTACATCACCTACTGGCAATGATG
GTAAAATTGGCATTCTAATTGATGGAGGAACTACTTCACCAGGCGTTATGCACATTA
AAAATGTTGAGGTTGATGGTGCATGGTGGGCCATATATGATGACTCTGGAAATTACC
TAACAAAGTATACCCAGGTATGGGCGAGGAGAGTTGCGCATGGTTTCTATAAGGCG
AACGGAACGACAATACAGTGGGATACATGTTATGTGCTGGATGCAGCACAGGCATG
GTATGTTGTAAATTGCCTGTCTCCTCAGCTAATAAACTGTGCAGGAGACCAGATCAC
AGTTGACGGGTCGCAATATACATTTGATTCCTCAGGGTTATATTTTTCTGGATGTAAG
TGTCTTACTATTACAGGGTATGATGGTGAGTCTAATATAATAAAAAATACAAATGGA
ATTACTGCGTCGTATATAAAACTTAATGATACTATTGCCCATATATCAGGATTGGCC
GGGCATGGAAACTCAATGCAAACAACGGGGAGTGGGACAGCAGCATTTATCTTTGC
AACAGGCACAAGCATTGTTAACATAAAATCAAGTACCGATAGCTTCCTTGATAGCG
AATCAATAACCTACACTGGCTCTGGATACCCAAACACATTGCTGACAGACTCAACA
GCAAAAATAATTGCTGAGGGATGCCGGTTTAAGGCTCCGACTGGTGGGACTCCTGTA
ATATCAACTTACAGCACAGGGAATGGAGTATTTACTGACTGCTCATTAACTGGGACG
CAAACTTCAGGCTCATATGTTGAATCACGAAGCTCTGCAGGTAATCAGTTGCCAGCA
GTGTACACAGCGAAAGGAACTCAGGCTGTTGCAGCTAACGTAGCAACTACGTTGTTT
GAACTGCCAAATAGCCAAGGGATGTACCTGATAAGCGTTTGGGCAGAAAGCAGTGG
AACAAATTTCTCTTCGCTTCAGCTTGCCATGTGGGACGGAACAACACTTACTTTAAC
TCCGCTTAAGTCAGGAGGGTTGATATCATTTACAGTGACAGGAAGGATTGTAACCAT
CACAAGCCAGGGAACAACAACATTTAACTGGACATACACCAAGGCAGGG
```

1AR
(SEQ ID NO: 113)

```
ATGGCAGTAAAGATTTCAGGAGTCCTGAAAGACGGCACAGGAAAACCGGTACAGAA
CTGCACCATTCAGCTGAAAGCCAGACGTAACAGCACCACGGTGGTGGTGAACACGG
TGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATC
ACCGTGTATGAAGATTCACAACCGGGGACGCTGAATGATTTTCTCTGTGCCATGACG
GAGGATGATGCCCGGCCGGAGGTGCTGCGTCGTCTTGAACTGATGGTGGAAGAGGT
GGCGCGTAACGCGTCCGTGGTGGCACAGAGTACGGCAGACGCGAAGAAATCAGCCG
```

-continued

```
GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

ACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGatcgctacccgcgtgtccaaagaaggtgacactatgactggtaagctgactctgtctgcgggtaacgatgcgct ggtgctgactgcgggcgagggcgcgtcctcgcacattcgctctgacgtgggcgggacgaacaactggtatatcggtaaaggcagtg gggataacggtttaggatctactcatacatcactcagggcggggtgtatattaccaacaacggggaaatcgctttaagcccgcagg gtcagggtacgtttaacttcaaccgtgatcgtctgcacatcaacggcacgcaatggacggcacatcaaggcggtggctgggaaaac cagtggaatcaggaagcgccgattttattgatttcggcaacgtgggcaatgatagctactacccgattatcaaaggtaagtccgg cattaccaacgaaggttatatttctggcgtggacttcggtatgcgtcggattactaacacgtgggcgcagggtattatccgcgtag gcaatcaggaaaacggtagcgatccgcaggccatctacgagttccatcataatggcgtactgtacgttcctaatatggtaaaaacg ggtgcgcgtctgagcgcaggtgggggggatccggtatggcagggtgcatgtgttgttatcggtgacaatgacacgggcttagtgca tggtggcgatggtcgcatcaatatggttgcaaacggtatgcacattgcgtcttggagttccgcgtatcatttacatgagggtttat gggatactacgggcgcgttatggacggagcaagggcgtgcaattatcagatcggtcatctggtacaacaaagcgatgcctattcca cctttgtccgtgatgtatacgttcgttcggatattcgcgttaaaaaagatctggtgaaattcgaaaacgctagcgaaaaactgtcc aaaatcaacggttatacttatatgcagaaacgcgggttagacgaagaaggtaatcagaaatgggagcctaacgccggattaatcgc gcaggaagtgcaggcgattctgccggaactggtagaaggcgatccggacggtgaagcattattacgtctgaactacaatggcgtga tcggcctgaatactgcggcgattaatgaacatacggcagagatcgcggagctgaaaagcgagattgaagaactgaaaaaaattgtc aaaagcctgttaaag
```

1AR-AP1

(SEQ ID NO: 114)
```
atggcagtaacaggaccgtgggtaggatcgtctgcagtagttaatacaggacaaaattggatggtcggcgcggcccaacgattaag aatgggtgctccgttctggatgagcaacatgattgggcgctctgttgaagtgattcatacgttaggcgcagatcataattttaatg gtcaatggtttcgtgaccgttgattgaggcgggcagtgcgccgatcgtgtttaacatcactggcgatttagtttcttactcccgtg acgttccgctgttttttcatgtatggtgacacgccgaacgagtatgtacaattaaacattcacggtgtcacgatgtacgggcgcggg
```

-continued ggcaacggttgggcggcgggtgcaatcggtgcgagcgatggcggggtgtgcatccagaatgatattggaggccgactgcgtatcaa caatggtggggcaatcgcgggcggtggcggtggtggggtggttattctcaggctaacaattgggcaggtaagtacgtttgcggtg gcggtggcggtcgtccgttcggcttaggtggcaacaacggtgcgcgttggcctgggggcaacgctagcctgacctcgccgggcgca ggtgggaacactggcacgcgttattacgctggcggggaggtgaggttggtcagccgggtcagtatgcaaaccccggcgcgggtta ctccaccccaccaacgtcgccgggcgcggcagttgcaggtagtgcgccaacttggcaaaacgtgggcgctatttatggcccgcgtg tttaa 1AR-AP2                                                                                          (SEQ ID NO: 115)

ATGAGTGAACAGACCATCGAACAAAAATTAAGCGCGGAAATCGTGACTCTGAAAAG

TCGCATTCTGGATACTCAGGACCAGGCAGCACGTCTGATGGAAGAGTCTAAAATCTT

GCAGGGCACTCTGGCAGAAATTGCCCGTGCGGTGGGTATCACAGGCGACACGATCA

AAGTAGAAGAAATTGTGGAGGCCGTAAAGAATCTCACAGCGGAGAGCACCGATGA

AGCAAAAGACGAAGAATAA 13-13.0                                                                                          (SEQ ID NO: 116)

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

ACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

-continued

```
GGCAGGGATATTCTGGCAAAAAATTCCGTTGCAGATGTTCTTGAATACCTTGGGGCC

GGTGAGAATTCGATCATCCAGTTAGAAGATAGTCAAGGCGCCCATTTTTCCACTGAA

CGTACTTTAGCGACAGGTGCAATTAAAACTCGTTTCTTTGGCGAAACATTTACTGAT

GGTACATTATACCTAAATCAGATGAATAATAGTTCTGAACGATTCTCTATTAATAAT

TGGGGAAATTCAGAAGTTGGTCGCCCGGCAGTGTTGGAAGTCGGTGATTCCAAAGG

TTATCACTTCTATACGGAACGCGGGACAGATAACAGTTTGAATTTTGATGTTGCTGG

CAATTTTACTGTGCATGGACCTTCCGGGATTACTATCAAAACCTCTACTGGTGCTCGC

CATATCTGGTTTAGAGATGATAGCGATGCAGAAAAGGCTGTTATCTGGGCTACAGAT

GAGGGTATTTTACATATACGAAATAATTATGGGGGTTCATTTAGTCATCACTTCCAG

GGTGCAATGATTCTAGCGGGAGAGCGTGTTCCATATAATAGTGAATACGCTCTTATC

CGTGGTAATATTTCCGGTGGTGCATGGGTAGACTGGCGAGGTCGTCCGGCTGGATTG

TTGGTAGACTGTCAGGACTCACGAAATCAAGCATATAACATTTGGAAAGCTACTCAT

TGGGGCGACCAGCACCTTGCGGCGATGGGTGTTCATGCTGGCGGTGGTAATCCTCAG

GTTGTATTGCATGTGGGTGGGAATGATTATGCATTTGCATCTAACGGTGATTTTACTG

CTGGTGCTGCTGTATATTGTAACGACGTTTATATTCGTTCTGACCGTCGTCTGAAAAT

TAATGTTAAAGACTACGAAGAGAATGCGGTGGATAAGGTAAATAAACTCAAAGTTA

AAACCTATGATAAAGTTAAATCTCTTTCTGACCGCGAAGTTATCGGCCATGAGATTG

GTATTATCGCACAGGATTTGCAAGAAGTATTACCGGAAGCTGTTAGCACTTCTAGTG

TCGGATCTCAGGATAACCCAGAAGAAATTTTAACAATTTCTAACTCTGCTGTGAACG

CGCTTTTAATTAAGGCTATTCAGGAAATGAGTGAAGAAATTAAAGAATTGAAAACG

CCTCTCTTTACTAAAATTGCTCGCAAAATTAGTAAATATTTTAAATTCTAA 13-13.0-AP1                                                  (SEQ ID NO: 117)

ATGGCAGTAGTTGGAGTTCCTGGCTGGATTGGAAGTTCAGCCGTAAATGAAACGGG

TCAGCGCTGGATGAGTCAAGCAGCTGGTCAATTAAGATTGGGTGTTCCTTGCTGGAT

GAGTCAATTTGCAGGTCGCTCAAGAGAAATTATTCATACACTTGGAGCAGACCATAA

CTTCAATGGTCAATGGTTCCGAGATAGATGTTTTGAGGCAGGTAGTACACCTATAGT

GTTTAATATCACTGGAGATTTAGTATCATATTCTAAAGATGTTCCTTTATTCTTCATG

TACGGAGATACACCGAATGAATATGTTCAACTGAATATACACGGCGTAACGATGTA

TGGACGTGGCGGTAATGGCGGTAGCAATAGTCCTGGTTCAGCTGGAGGTCATTGTAT

TCAAAACGATATTGGTGGGAGACTAAGAATTAATAACGGTGGAGCTATTGCCGGCG

GCGGCGGTGGCGGCGGTGGCGGTAGATATGGCAGACTATCATTTGGTGGTGGCGGT

GGTCGCCCATTCGGTGCTGGCGGGTCTTCCTCTCATATGAGTTCCGGTGCAACTGCT

GGCACCATTTCCGCTCCGGGTGCAGGATCTGTCGGTGAGGGaTCTCTTTGGGTATATA

CAGGCGGTTCGGGTGGTAATGTCGGTGCTGCTGGAGGAAGATGTAATATTCAAGGT

AACGGTACAGAATATGATGGCGGTGCTGCTGGTTATGCTGTTATAGGGTCTGCTCCA

ACTTGGATAAATGTTGGAGCAATATATGGTCCAAGAGTATAA 13-13.0-AP2                                                  (SEQ ID NO: 118)

ATGTCTGAACAAACTATTGAACAAAAACTGTCTGCTGAAATCGTAACTCTGAAGTCT

CGTATCCTTGATACGCAGGACCAAGCGGCTCGTCTGATGGAAGAATCCAAAATTCTG

CAAGGAACTTTGGCTGAAATTGCTCGTGCAGTAGGTATCACTGGCGATACTATCAAA

GTTGAAGAAATCGTTGAAGCTGTCAAGAATCTTACTGCTGAATCTGCAGATGAAGCA
```

AAAGATGAAGAATGA

5) INSERTION POINT SAGDAS
13-14.3

(SEQ ID NO: 119)

ATGGCAGTAAAGATTTCAGGAGTCCTGAAAGACGGCACAGGAAAACCGGTACA

GAACTGCACCATTCAGCTGAAAGCCAGACGTAACAGCACCACGGTGGTGGTGA

ACACGGTGGGCTCAGAGAATCCGGATGAAGCCGGGCGTTACAGCATGGATGTG

GAGTACGGTCAGTACAGTGTCATCCTGCAGGTTGACGGTTTTCCACCATCGCA

CGCCGGGACCATCACCGTGTATGAAGATTCACAACCGGGGACGCTGAATGATT

TTCTCTGTGCCATGACGGAGGATGATGCCCGGCCGGAGGTGCTGCGTCGTCTT

GAACTGATGGTGGAAGAGGTGGCGCGTAACGCGTCCGTGGTGGCACAGAGTA

CGGCAGACGCGAAGAAATCAGCCGGCGATGCCAGTATTTCTGATGATATTGGA

TGGATGCATTATATTCAACGAAATAAAGATAATACAGTTGAAGCCGTATTAAAT

GGTCAACAGACAATTAACGAAAATATTATTGCGAAAAAGGATATTTGGGTTGAC

CGAGCAGTTCACACCCTTGGCGAAATCACTACAAATGCTGTTAATGGTCTTCGT

ATTTGGAATAATGATTATGGAGTCATTTTTAGACGTTCAGAAGGAAGTCTTCAT

ATTATTCCTACCGCATTTGGTGAAGGAGAAACCGGTGATATTGGACCTTTACGT

CCTCTCAGTATAGCTTTAGATACCGGTAAAGTTACTATTCCGGATTTACAATCA

AGTTACAATACGTTCGCTGCTAACGGTTATATTAAATTTGTTGGTCATGGAGCG

GGGGCCGGCGGTTATGACATTCAATATGCTCAAGCGGCTCCTATTTTCCAGGA

AATCGATGATGATGCTGTAAGCAAATATTATCCTATTGTTAAACAGAAGTTTTT

AAACGGTAAATCCGTTTGGTCTTTAGGTACCGAAATTGAATCAGGTACATTCGT

TATTCATCATCTGAAAGAAGATGGTTCACAAGGCCATGCGTCTCGTTTTAATCA

AGACGGTACTGTTAACTTCCCGGATAACGTTCTGGTCGGCGGTGATATTAACAT

GAAAGGCATGATGACTTTTGACGCCGGACGTTTAGGATCACGAGATTATTTAA

ATTTAACCATTGGGGTGATAGTAATAATGGTCGTGATAACATCATCCAGTTAGA

AGATAGTCAAGGCGCCCATTTTTCCACTGAACGTACTTTAGCGACAGGTGCAAT

TAAAACTCGTTTCTTTGGCGAAACATTTACTGATGGTACATTATACCTAAATCA

GATGAATAATAGTTCTGAACGATTCTCTATTAATAATTGGGGAAATTCAGAAGT

TGGTCGCCCGGCAGTGTTGGAAGTCGGTGATTCCAAAGGTTATCACTTCTATAC

GGAACGCGGGACAGATAACAGTTTGAATTTTGATGTTGCTGGCAATTTTACTGT

GCATGGACCTTCCGGGATTACTATCAAAACCTCTACTGGTGCTCGCCATATCTG

GTTTAGAGATGATAGCGATGCAGAAAAGGCTGTTATCTGGGCTACAGATGAGG

GTATTTTACATATACGAAATAATTATGGGGGTTCATTTAGTCATCACTTCCAGG

GTGCAATGATTCTAGCGGGAGAGCGTGTTCCATATAATAGTGAATACGCTCTTA

TCCGTGGTAATATTTCCGGTGGTGCATGGGTAGACTGGCGAGGTCGTCCGGCT

GGATTGTTGGTAGACTGTCAGGACTCACGAAATCAAGCATATAACATTTGGAAA

GCTACTCATTGGGGCGACCAGCACCTTGCGGCGATGGGTGTTCATGCTGGCGG

TGGTAATCCTCAGGTTGTATTGCATGTGGGTGGGAATGATTATGCATTTGCATC

TAACGGTGATTTTACTGCTGGTGCTGCTGTATATTGTAACGACGTTTATATTCG

TTCTGACCGTCGTCTGAAAATTAATGTTAAAGACTACGAAGAGAATGCGGTGG

ATAAGGTAAATAAACTCAAAGTTAAAACCTATGATAAAGTTAAATCTCTTTCTG

```
ACCGCGAAGTTATCGGCCATGAGATTGGTATTATCGCACAGGATTTGCAAGAA

GTATTACCGGAAGCTGTTAGCACTTCTAGTGTCGGATCTCAGGATAACCCAGAA

GAAATTTTAACAATTTCTAACTCTGCTGTGAACGCGCTTTTAATTAAGGCTATT

CAGGAAATGAGTGAAGAAATTAAAGAATTGAAAACGCCTCTCTTTACTAAAATT

GCTCGCAAAATTAGTAAATATTTTAAATTC
```

13-14.3-AP1
(SEQ ID NO: 120)
```
ATGGCAGTAGTTGGAGTTCCTGGCTGGATTGGAAGTTCAGCCGTAAATGAAAC

GGGTCAGCGCTGGATGAGTCAAGCAGCTGGTCAATTAAGATTGGGTGTTCCTT

GCTGGATGAGTCAATTTGCAGGTCGCTCAAGAGAAATTATTCATACACTTGGAG

CAGACCATAACTTCAATGGTCAATGGTTCCGAGATAGATGTTTTGAGGCAGGTA

GTACACCTATAGTGTTTAATATCACTGGAGATTTAGTATCATATTCTAAAGATG

TTCCTTTATTCTTCATGTACGGAGATACACCGAATGAATATGTTCAACTGAATA

TACACGGCGTAACGATGTATGGACGTGGCGGTAATGGCGGTAGCAATAGTCCT

GGTTCAGCTGGAGGTCATTGTATTCAAAACGATATTGGTGGGAGACTAAGAAT

TAATAACGGTGGAGCTATTGCCGGCGGCGGCGGTGGCGGCGGTGGCGGTAGA

TATGGCAGACTATCATTTGGTGGTGGCGGTGGTCGCCCATTCGGTGCTGGCGG

GTCTTCCTCTCATATGAGTTCCGGTGCAACTGCTGGCACCATTTCCGCTCCGGG

TGCAGGATCTGTCGGTGAGGGaTCTCTTTGGGTATATACAGGCGGTTCGGGTG

GTAATGTCGGTGCTGCTGGAGGAAGATGTAATATTCAAGGTAACGGTACAGAA

TATGATGGCGGTGCTGCTGGTTATGCTGTTATAGGGTCTGCTCCAACTTGGATA

AATGTTGGAGCAATATATGGTCCAAGAGTA
```

13-14.3-AP2
(SEQ ID NO: 122)
```
ATGTCTGAACAAACTATTGAACAAAAACTGTCTGCTGAAATCGTAACTCTGAAG

TCTCGTATCCTTGATACGCAGGACCAAGCGGCTCGTCTGATGGAAGAATCCAA

AATTCTGCAAGGAACTTTGGCTGAAATTGCTCGTGCAGTAGGTATCACTGGCG

ATACTATCAAAGTTGAAGAAATCGTTGAAGCTGTCAAGAATCTTACTGCTGAAT

CTGCAGATGAAGCAAAAGATGAAGAA
```

T4-Like SEQUENCES (Underlined are the DTF Insertion
Sites Used in the Fusions Described Above):

WW13
(SEQ ID NO: 123)
```
MATLKQIQFKRSKTAGARPAASVLAEGELAINLKDRVLFTKDDQGNIIDLGFAKGGSIDGNVIHIG

NYNQTGDYTLNGTFTQTGNFNLTGIARVTRDIIAAGQIMTEGGELITKSSGTAHVRFFDGNSRE

RGIIYAPANDGLTTQVLNIRVQDYAAGSESTYAFSGSGLFTSPEVSAWKSMSTPQILTDKVITNG

KKTGDYDIYSLSNNTPLAESETAINHLRVMRNAVGAGIFHEVNVNDGITWYSGDGLDTYLWSFN

WAGGLKAGHSISVGLPGGSKGYSELGTASIALGDNDTGFKWHQDGYFHTVNNGTRTFIYGPA

ETQSLRKMVMGYSPDGILMTTPPTENYALATVVTYHDNNAFGDGQTLLGYYQGGNYHHYFRG

KGTTNINTHGGLLVTPGNIDVIGGSVNIDGRNNNSTLMFKGYTMGQSSVDNMYIAVWGNTFTN

PSEGTRKNVMEISDDIGWMHYIQRNKDNTVEAVLNGQQTINENIIAKKDIWVDRAVHTLGEITTN

AVNGLRIWNNDYGVIFRRSEGSLHIIPTAFGEGETGDIGPLRPLSIALDTGKVTIPDLQSSYNTFA
```

-continued

ANGYIKFVGHGAGAGGYDIQYAQAAPIFQEIDDDAVSKYYPIVKQKFLNGKSVWSLGTEIESGT

FVIHHLKEDSQGHASRFNQDGTVNFPDNVLVGGDINMKGMMTFDAGRLGSRDYFKFNHWG

DSNNGRDNIIQLEDSQGAHFSTERTLATGAIKTRFFGETFTDGTLYLNQMNNSSERFSINNWGN

SEVGRPAVLEVGDSKGYHFYTERGTDNSLNFDVAGNFTVHGPSGITIKTSTGARHIWFRDDSD

AEKAVIWATDEGILHIRNNYGGSFSHHFQGAMILAGERVPYNSEYALIRGNISGGAWVDWRGR

PAGLLVDCQDSRNQAYNIWKATHWGDQHLAAMGVHAGGGNPQVVLHVGGNDYAFASNGDF

TAGAAVYCNDVYIRSDRRLKINVKDYEENAVDKVNKLKVKTYDKVKSLSDREVIGHEIGIIAQDL

QEVLPEAVSTSSVGSQDNPEEILTISNSAVNALLIKAIQEMSEEIKELKTPLFTKIARKISKYFKF

PP-1 (SEQ ID NO: 124)

MATLKQIQFKRSKTAGQRPAASVLAEGELAINLKDRVLFTKDDQGNIIDLGFAKGGSIDGNVIHK

GNYNQTGDYTLNGTFTQTGNFNLTGIARVTRDIIAAGQIMTEGGELITKSSGTAHVRFHDSADR

ERGIIFSPANDGLTTQVVNIRVQDYKASSESTFAFNGNGLFSSPEVFGWKSVSTPVIYTNKVITN

KKVKDDYDIYSMADNVPLSEITTAINHLRVMRNAVGSGIFHEVKDNDGITWYSGDGLDAYLWSF

TWSGGIKSSHSISIGLTPGPKDYSILGPSSIALGDNDTGFKWHQDGYYFSVNNGTKTFLFSPSE

TTSLRKFVAGYSTNGTDLTTPPTENYALATVVTYHDNNAFGDGQTLLGYYQGGNYHHYFRGK

GTTNINTHGGLLVTPGNIDVIGGSVNIDGRNNASTAMFKGNTTGSSSVDNMTISVWGNTFTNPS

EGNRKNVMEISDATSWMSYIQRLTTGEVEMNVNGSFESSGVTAGNRGVHTTGEISSGAVNAL

RIWNADYGVIFRRSEGSLHIIPTAYGEGKNGDIGPLRPFSIALDTGKVVIPDLESSYNTFAANGYI

KFAGHGAGAGGYDIQYSQAAPIFQEIDDAAVSKYYPIVKQKFLNGKAVWSLGTEINSGTFVLHH

LKEDGSQGHTSRFNADGTVNFPDNVQVGGGEATIARNGNIFSDIWKTFTSAGETTNIRDA<u>IATR</u>

<u>V</u>SKEGDTMTGKLTLSAGNDALVLTAGEGASSHIRSDVGGTNNWYIGKGSGDNGLGFYSYITQG

GVYITNNGEIALSPQGQGTFNFNRDRLHINGTQWTAHQGGGWENQWNQEAPIFIDFGNVGND

SYYPIIKGKSGITNEGYISGVDFGMRRITNTWAQGIIRVGNQENGSDPQAIYEFHHNGVLYVPNM

VKTGARLSAGGGDPVWQGACVVIGDNDTGLVHGGDGRINMVANGMHIASWSSAYHLHEGLW

DTTGALWTEQGRAIISFGHLVQQSDAYSTFVRDVYVRSDIRVKKDLVKFENASEKLSKINGYTY

MQKRGLDEEGNQKWEPNAGLIAQEVQAILPELVEGDPDGEALLRLNYNGVIGLNTAAINEHTAE

IAELKSEIEELKKIVKSLLK

WW55 (SEQ ID NO: 125)

MADLSRIQFKRTSTKGRRPDASTMNPGELAINLADQYLLTKNDSGAIINLSCPPVYDRDVTMAG

KVKGNNYILSKTANYLEDQTARDLNYFGAFRTNGLDGLLELTLNVPHSSGVQHGRGFTFQYGH

TGSRVETYGYNKEGQKAFSYKMYHEGDKP<u>TPGEL</u>NVYSKQEIDRMFVKNVKMVVPSGGATR

GYFKIASAMIPQSGRMAFLRIYGGNGYNVNSYDQVDFLEIVIRSGNNNPKGVSIAAYRRNSLNV

HEVFAINTSGDNYDIYVNYGRFTDNVIVEFGKTVDVALTVHDVPEFSATKPETGTKFDARVITMF

NTENKAGTLMFDNNNQLTYDIVSLSNGPDDVRNYLRKFRSKAGEMIWHETVQGAVYRLATGTT

DSTEVLRVDSNSALPGSYKGYVITGKMELHGSGSAMNLHRQTGQAAYMAWWDRRDGKNQR

SGYIGHADGTTDGFVWRNDVGANSFDLESSGQVNLTTGKTKIVYTNGQYYSANSDAFRMIYG

NYGAFWRNDGGKVYLLSTAENDRFGGWNGNRPFIYDLSTGKVTLGGDGNEGALVLERDSRA

ARFSNSVFLEKGLLTFSAGGNQSMDSFTINHWGNSNAGRYNVLQFEDTKGTHFTTERNADGG

LLAHFRGDLTTEGKLTWGKGTATSSFNIRAWGNSDSRKQVFECVDESGWHWYTQRPGGPGT

SAIEFAINGTVKPQAIHTGGNILLNGADIEFRRTGNKHLWFRDPNGLELGLIYCDDNGVIRFRGQ

KQGQDWVFANKMIQLGTASTVGGSGNGLIRGQVQGGAWAQWRDRAAGILVDCQQSTDSAH

-continued

NIWKATHWGKYHIAAMGVHVPSGTIGNAMARLNVNDANFDFSASGDMSAGRNGSFNDVYIRS

DARLKINKEEYKENATDKVNRLTVYTYDKVKSLTDRTVIAHEVGIIAQDLEKELPEAVTTSKIGDP

DKPEEILTISNSAVNALLIKAFQEMSEELKAVKAELAELKK

WW34

(SEQ ID NO: 126)
MADLSRIQFKRTSTKGRRPDAGTMNPGELAINLADQYLLTKNDSGAIINLSCPPVYDSDVTMAG

KVKGNNYILSKTANYFEDQTARDLNYFGAFRPNNADDWSNLILNIPHPSGKAHGRGFEFQYGS

SSSQVKTYGFDKDGNKRFSFRMYHEGDKPTPGELNVYSKQEIDRMFVKNVKMSTPSGEATRG

YFKIASAMIPQSGRMAFLRIYGGNGFNVNSYDQVDFLEIVIRSGNNNPKGVSIAAYRRNSLNVH

EVFAINTSGDNYDIYVNYGRFTDNVIVEFGKTVDVALTVHDVPEFSATKPETGTKFDARVITMFN

TENKAGTLMFDNNNQLTYDIVSLSNGPDDVRNYLRKFRSKAGEMIWHETVQGAVYRLATGTTD

STEVLRVDSNSAIPGSYKGYVITGKMELHGSGNSMILHRQTAQAAYMSWWDRRDGKNQRSG

YIGHADGTSDAIVWNNDIGQNSAVLETSGQISFRTGATKIVYTNGQYYSANSDAYRMIFGNYGA

FWRNDGTKVYLLSTAENDKYGGWNAYRPFIYDLTSGNVQLGGDGNEDALTLECASRAARFSN

DVYIKKGLLTFDAGRAGSRDYIRFNHWGDSNNARDNVLCIEDSQGRHFSTERAMGTGALKAYF

LGDLEVGGKFTWGKNTATSSFNIRAWGNDSRKQVLECADESGWHWYTQRTGGPDTSAIDFAI

NGTVRPQAIHTGGNITINGADIEFKRTGNKHIWFRDPNGLELGLMYCDDAGAIRFRGQKQAQA

WKFADKMIQLESGTVSGGGNGLIRGEVAGGSWASWRDRAAGLMVGCPQSTNSAHNVWKAT

HWGKYHIAAMAVHVPDGTITNALARLNVHDANFDFSASGDLSAGRNGSFNDVYIRSDARLKINK

EEYKENATDKVNRLTVYTYDKVKSLTDRTVIAHEVGIIAQDLEKELPEAVTTSKIGDPDKPEEILTI

SNSAVNALLIKAFQEMSEELKAVKAELAELKKN

WW14

(SEQ ID NO: 127)
MATLKAIQFKRSKTPGAKPTVDQLVEGELAINLRDRTIFTKSDQNQIIDLGFAKGGQVDGDVTIN

GTLNLNGPEIVASGGYIEFNYRTTGSGSWAGQHAAKAPIFVDLSAALSTSEYNPLFKQRYKDGT

FSAGTLVTEGSFKFHYINEAGDSKYWTFNRNGNFQVDTGSLFVSGGNISASGNINSASGFVSA

PQINTKNIILDTKAFGQYDSQSLVNYVYPGTGETNGVNYLRKVRAKSGGTMWHELCTAQLGQA

DEMSWWTGNTPQSKQYGVRNDGRLIGRNSLALGTMTTDFPSSDYGNTGAMGDKYLVLGDTA

TGLKYIKQGNFDLVGGGYSVASITTDGFRGTSKTLFGRSNDQGLTWLLPGQNSAMVSIRTEIDG

NNSGDGQTHLGYNSNGKLYHYFRGTGRVAISMAEGMIIEPGILNIKTGVNELNLRADGTVSTTQ

RLMVNNGLVLNANNNTSALALTAPTGVDGTKTINWDAGTRNGQNKNTVTMKAWGNSFNAGG

GNRETVFEVSDSQGYYFYGQRTNPASGETVGPINFKFNGSVETGHFSSLGNISASGTGSFGG

NVTMTNGLFVQGGASINGQVKMGGTADALRIWNAEYGMIFRRSETGSSASFHLIPTLQNAGEN

GGISDLRPLSINLASGTVIMGNKSTGGPLFTVDNVSKFVQTDCRLRVNMDSDGIVLNASSQAAS

NFIQGRKADVTKWYLGIGDGGNVVRMHNYTYSHGIALNSDTVDITKPLKIGSDIRIGTDGNIIGSA

TLDNFKNLNTTLDHKVNMGGWSGGATTGWYKFATVEIPQATGTASFKIFGGSGFNFKSYGQA

SIAEIILRTGNNNPKGLNATLWNRTSEAISQIASVNTSEDIYDIYVYLGGYSNSLVVEYTCSSNSK

VTVVGMDGGVQPLVETLPEGHVVGKSVRMLNNLDGMFAAGESDIVTRGEYVTNNQKGMRIKS

KGNDLDSNAALLRNDGGSFYILATDKNTTEKPDAANGDWNGLRPFSINMADGRVGMNHGLNIT

GGGLNVTGGNTNLGNITSRVVSSARAGSGWGDNSDAMKSKITFMADHGDLSNSGSYYPIVGA

-continued

YSNYGSAGYRQTFEFGWVGSGSTANWREGIIRIRGDNANGQQARWRFTMDGILGCPGKVEM

PETSAFGINTTNGFGGNSIVIGDSDTGFRQVGDGLLEVWTNASRRMRFQGGDTYSDMNINAPN

VYIRSDIRLKSNFKPIENALDKVEQLDGLIYDKADYIGGEVVHTEAGVIAQSLEKVLPEAVREVDD

IKGNKVLTVSTQAQVALLIEAVKTLSAKVKELEAKLN

WW170

(SEQ ID NO: 128)

MADLSRIQFKRTSTKGRRPDASTMNPGELAINLADQYLLTKNDSGAIINLSCPPVYDRDVTMAG

KVKGNNYILSKTANYLEDQTARDLNYFGAFRTNGQDGLLDLTLNVPHSAGVNHGRGFTFRYAT

GGSRVETYGYNAQGQKAFSYKMYHEGDKPTPSELNVYSKQEVDRMFVKTVKLATVPVDIVDG

YFKLATAMIPQNGRSVFFRIHGGNGYNVTAYDQVDIVEIVIRSGNNRPKGVNVIAYRRNTNKAF

DVLAVNTSGDNYDIYVKYQRYTDNVIVEFGKSVDVDLVVHDVPDFVVDRPVGDNVIGGRAVTLF

NTENKRGVLSFDDNTQNSYDIVHLSNDRGTGRKYIRKFRSNYNEMIWHETVQGSTYRLATGST

DAQEILSVESSSSIAGTHKGNILSGRMMLGGGSNVITLRRPAGQSNHIAFQDNRTGSITRQGWI

GYGNADTNVFEWYSDVGGTSIRHHIDGQIELATGNTKRVYTNAQFISMNSDAYRMIFGNYGAF

WRNDGTKVYLLSTAEDDKFGGWNGNRPFIYDLTNGKVTLGGDGNEGALVLERDSRAARFAGD

VYVEKGFLHFSSGRQGASGFMKINHLGDIASGRHNILQIEDPTGIHFSTERNDETGNITARFKGF

VRVEAGEIAFDANRGSQSQFTLHTWGNEQRKQVFECKDATGYHWYTERTQGGTGNVLFSMA

GSLNVTSNITTTGADITFKRAGNKHIWFRDPDGLELGLMYCDDAGAIRFRGQKQAQAWKFADK

MIQLESGTVSGGGNGLIRGEVAGGSWSSWRDRAAGLMVGCPQSTNSAHNVWKATHWGKYHI

AAMGIHVPDGTIGNALARLHVHDTNFDFSASGDMTAGRNGSFNDVYIRSDARLKINKEEYKENA

TDKINRLTVYTYDKVKSLTDRTVIAHEVGIIAQDLEKELPEAVTTSKVGDPDKPEEILTISNSAVNA

LLIKAFQEMSEELKAVKAELAELKKN

WW202

(SEQ ID NO: 129)

MADLNRIQFKRTSTAGRKPDAGTMNPGELAINLADQYLLTKNDDGQIVNLSCPPVYDKGFDVR

GRVVVDDLVWSNTANYFDDPTARNLDKFGAFRTNDMDGHLAFALHIPHPSGINHARGFDFTYG

SNVVPTVKTYGYNADGVLAYSYRMYHEGDKPSPSELNVYSKQEVDRMFQKTINFGVETGWFK

IATAFIPQNDGRSLKIRLVGGNGWNVGQTGQCNIIELVIRTSNGSPKGINFVAYHHVSGYENQFC

AINTGDDTYDIYAYYYEFTNMVMAEYQASSDVNLTVFDRPEYVGEKPVAEHIFDAYTIHSFNSFS

NRGTLNFAGNHQGQYDIEHMNEQPTNAKKMLRRFRSSASATIWHETVDDQNYRLATGGTDSV

QQLLLSSGTGLHIRRLTIDGGLGSGSNAGIDIRRGPNESSHFNFMDYRTGQDVRNGWFGFGDL

TTKDFIWWNDNGQNSINLIENGELHITGGRGQKIVMNSEVALSENARLAVKGGNYGLILRNDGT

GFHILTTDLKDSFGSWNNRRPFSYNFADGGLYLGGTETARCLHLGIDGSTRLEDNLFFKAGSR

QSMDYMELVHWGASNTGRNNVLSLRDSKGFLAEFERVGGTDGVKTRFFGETFTDGTLYLNQ

MNNSSERFSINNWGNSEVGRAAVMEVGDSKGYHFYAERRTDDTVLFDVSGALTVHGPNGITV

KNSTGARHIWFRDDSDTEKAVIWATDDGMLHIRNNHEGSFAHHFQGAMIKLEGRVPYGAAKGL

IRGEVDGGAYVAWRDRPAGLLVDCQKSIDSAHAVWKAVDWGRQYIAAMDVHCPGDGNNTAA

AVLHVQAADYQFHASGEFHASGNGNFNDVYIRSDRRLKDNIEDYTGNALSLIGKLKVKTYDKVK

SLKDREIIGHEIGIIAQDLQEILPEAVKSSKVGNLDNPDDVLTISNSAVNALLIKAIQEMSEEIKELK

TPFFTKIARKISKYFKF

Chimeras SEQUENCES (Underlined are the Sites Used in the Fusions Shown Above):

WW13 13.0 (FIG. 8)
(SEQ ID NO: 130)

*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNRKAPLDSPALTGTPTAPTALRGTNNTQIANTAFVLAAIADVIDASPDALNTL*

*NELAAALGNDPDFATTMTNALAGKQPKNATLTALAGLSTAKNKLPYFAENDAASLTELTQVGR*

*DILAKNSVADVLEYLGAGENS*<u>IIQLED</u>SQGAHFSTERTLATGAIKTRFFGETFTDGTLYLNQMN

NSSERFSINNWGNSEVGRPAVLEVGDSKGYHFYTERGTDNSLNFDVAGNFTVHGPSGITIKTS

TGARHIWFRDDSDAEKAVIWATDEGILHIRNNYGGSFSHHFQGAMILAGERVPYNSEYALIRG

NISGGAWVDWRGRPAGLLVDCQDSRNQAYNIWKATHWGDQHLAAMGVHAGGGNPQVVLH

VGGNDYAFASNGDFTAGAAVYCNDVYIRSDRRLKINVKDYEENAVDKVNKLKVKTYDKVKSL

SDREVIGHEIGIIAQDLQEVLPEAVSTSSVGSQDNPEEILTISNSAVNALLIKAIQEMSEEIKELKT

PLFTKIARKISKYFKF

WW13 10.0
(SEQ ID NO: 131)

*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*<u>VDRAV</u>HTLGEITTNAVNGLRIWNNDYGVIFRRSEGSLHIIPTAFGEGETG

DIGPLRPLSIALDTGKVTIPDLQSSYNTFAANGYIKFVGHGAGAGGYDIQYAQAAPIFQEIDDD

AVSKYYPIVKQKFLNGKSVWSLGTEIESGTFVIHHLKEDGSQGHASRFNQDGTVNFPDNVLV

GGDINMKGMMTFDAGRLGSRDYFKFNHWGDSNNGRDNIIQLEDSQGAHFSTERTLATGAIKT

RFFGETFTDGTLYLNQMNNSSERFSINNWGNSEVGRPAVLEVGDSKGYHFYTERGTDNSLNF

DVAGNFTVHGPSGITIKTSTGARHIWFRDDSDAEKAVIWATDEGILHIRNNYGGSFSHHFQGA

MILAGERVPYNSEYALIRGNISGGAWVDWRGRPAGLLVDCQDSRNQAYNIWKATHWGDQHL

AAMGVHAGGGNPQVVLHVGGNDYAFASNGDFTAGAAVYCNDVYIRSDRRLKINVKDYEENA

VDKVNKLKVKTYDKVKSLSDREVIGHEIGIIAQDLQEVLPEAVSTSSVGSQDNPEEILTISNSAV

NALLIKAIQEMSEEIKELKTPLFTKIARKISKYFKF

WW13-G8 (FIG. 10)
(SEQ ID NO: 132)

*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

-continued

EAAGSAVSASQSKSAAEAAAIRAKNSAKRAEDIASAVALEDADTTRKGIVQLSSATNSTSETLAA

TPKAVKVVMDETNRGNIIDLGFAKGGSIDGNVIHIGNYNQTGDYTLNGTFTQTGNFNLTGIARV

TRDIIAAGQIMTEGGELITKSSGTAHVRFFDGNSRERGIIYAPANDGLTTQVLNIRVQDYAAGS

ESTYAFSGSGLFTSPEVSAWKSMSTPQILTDKVITNGKKTGDYDIYSLSNNTPLAESETAINHL

RVMRNAVGAGIFHEVNVNDGITWYSGDGLDTYLWSFNWAGGLKAGHSISVGLPGGSKGYSE

LGTASIALGDNDTGFKWHQDGYFHTVNNGTRTFIYGPAETQSLRKMVMGYSPDGILMTTPPT

ENYALATVVTYHDNNAFGDGQTLLGYYQGGNYHHYFRGKGTTNINTHGGLLVTPGNIDVIGG

SVNIDGRNNNSTLMFKGYTMGQSSVDNMYIAVWGNTFTNPSEGTRKNVMEISDDIGWMHYIQ

RNKDNTVEAVLNGQQTINENIIAKKDIWVDRAVHTLGEITTNAVNGLRIWNNDYGVIFRRSEGS

LHIIPTAFGEGETGDIGPLRPLSIALDTGKVTIPDLQSSYNTFAANGYIKFVGHGAGAGGYDIQY

AQAAPIFQEIDDDAVSKYYPIVKQKFLNGKSVWSLGTEIESGTFVIHHLKEDGSQGHASRFNQ

DGTVNFPDNVLVGGDINMKGMMTFDAGRLGSRDYFKFNHWGDSNNGRDNIIQLEDSQGAHF

STERTLATGAIKTRFFGETFTDGTLYLNQMNNSSERFSINNWGNSEVGRPAVLEVGDSKGYH

FYTERGTDNSLNFDVAGNFTVHGPSGITIKTSTGARHIWFRDDSDAEKAVIWATDEGILHIRNN

YGGSFSHHFQGAMILAGERVPYNSEYALIRGNISGGAWVDWRGRPAGLLVDCQDSRNQAYN

IWKATHWGDQHLAAMGVHAGGGNPQVVLHVGGNDYAFASNGDFTAGAAVYCNDVYIRSDR

RLKINVKDYEENAVDKVNKLKVKTYDKVKSLSDREVIGHEIGIIAQDLQEVLPEAVSTSSVGSQ

DNPEEILTISNSAVNALLIKAIQEMSEEIKELKTPLFTKIARKISKYFKF

WW13 gp38
(SEQ ID NO: 133)
MAVVGVPGWIGSSAVNETGQRWMSQAAGQLRLGVPCWMSQFAGRSREIIHTLGADHNFNGQ

WFRDRCFEAGSTPIVFNITGDLVSYSKDVPLFFMYGDTPNEYVQLNIHGVTMYGRGGNGGSNS

PGSAGGHCIQNDIGGRLRINNGGAIAGGGGGGGGRYGRLSFGGGGGRPFGAGGSSSHMSS

GATAGTISAPGAGSVGEGSLWVYTGGSGGNVGAAGGRCNIQGNGTEYDGGAAGYAVIGSAP

TWINVGAIYGPRV

WW13 gp57A
(SEQ ID NO: 134)
MSEQTIEQKLSAEIVTLKSRILDTQDQAARLMEESKILQGTLAEIARAVGITGDTIKVEEIVEAVKN

LTAESADEAKDEE

PP-1 (FIG. 8)
(SEQ ID NO: 135)
MAVKISGVLKDGTGKPVQNCTIQLKARRNSTTVVVNTVGSENPDEAGRYSMDVEYGQYSVILQ

VDGFPPSHAGTITVYEDSQPGTLNDFLCAMTEDDARPEVLRRLELMVEEVARNASVVAQSTAD

AKKSAGDASASAAQVAALVTDATDSARAASTSAGQAASSAQEASSGAEAASAKATEAEKSAA

AAESSKNAAATSAGAAKTSETNAAASQQSAATSASTAATKASEAATSARDAVASKEAAKSSET

NASSSAGRAASSATAAENSARAAKTSETNARSSETAAERSASAAADAKTAAAGSASTASTKAT

EAAGSAVSASQSKSAAEAAAIRAKNSAKRAEDIASAVALEDADTTRKGIVQLSSATNSTSETLAA

TPKAVKVVMDETNRKAPLDSPALTGTPTAPTALRGTNNTQIANTAFVLAAIADVIDASPDALNTL

NELAAALGNDPDFATTMTNALAGKQPKNATLTALAGLSTAKNKLPYFAENDAASLTELTQVGR

DILAKNSVADVLEYLGAGENSIATRVSKEGDTMTGKLTLSAGNDALVLTAGEGASSHIRSDVG

GTNNWYIGKGSGDNGLGFYSYITQGGVYITNNGEIALSPQGQGTFNFNRDRLHINGTQWTAH

QGGGWENQWNQEAPIFIDFGNVGNDSYYPIIKGKSGITNEGYISGVDFGMRRITNTWAQGIIRV

GNQENGSDPQAIYEFHHNGVLYVPNMVKTGARLSAGGGDPVWQGACVVIGDNDTGLVHGG

DGRINMVANGMHIASWSSAYHLHEGLWDTTGALWTEQGRAIISFGHLVQQSDAYSTFVRDVY

VRSDIRVKKDLVKFENASEKLSKINGYTYMQKRGLDEEGNQKWEPNAGLIAQEVQAILPELVE

GDPDGEALLRLNYNGVIGLNTAAINEHTAEIAELKSEIEELKKIVKSLLK

PP-1 gp38

(SEQ ID NO: 136)
MAVTGPWVGSSAVVNTGQNWMVGAAQRLRMGAPFWMSNMIGRSVEVIHTLGADHNFNGQW

FRDRCFEAGSAPIVFNITGDLVSYSRDVPLFFMYGDTPNEYVQLNIHGVTMYGRGGNGWAAG

AIGASDGGVCIQNDIGGRLRINNGGAIAGGGGGGGYSQANNWAGKYVCGGGGGRPFGLGG

NNGARWPGGNASLTSPGAGGNTGTRYYAGGGGEVGQPGQYANPGAGYSTPPTSPGAAVAG

SAPTWQNVGAIYGPRV

PP-1 gp57A (SEQ ID NO: 137)
MSEQTIEQKLSAEIVTLKSRILDTQDQAARLMEESKILQGTLAEIARAVGITGDTIKVEEIVEAVKN

LTAESTDEAKDEE

>WW55 3.0 (FIG. 9)

(SEQ ID NO: 138)
*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*__TPGEL__NVYSKQEIDRMFVKNVKMVVPSGGATRGYFKIASAMIPQSGRM

AFLRIYGGNGYNVNSYDQVDFLEIVIRSGNNNPKGVSIAAYRRNSLNVHEVFAINTSGDNYDIY

VNYGRFTDNVIVEFGKTVDVALTVHDVPEFSATKPETGTKFDARVITMFNTENKAGTLMFDNN

NQLTYDIVSLSNGPDDVRNYLRKFRSKAGEMIWHETVQGAVYRLATGTTDSTEVLRVDSNSA

LPGSYKGYVITGKMELHGSGSAMNLHRQTGQAAYMAWWDRRDGKNQRSGYIGHADGTTD

GFVWRNDVGANSFDLESSGQVNLTTGKTKIVYTNGQYYSANSDAFRMIYGNYGAFWRNDGG

KVYLLSTAENDRFGGWNGNRPFIYDLSTGKVTLGGDGNEGALVLERDSRAARFSNSVFLEK

GLLTFSAGGNQSMDSFTINHWGNSNAGRYNVLQFEDTKGTHFTTERNADGGLLAHFRGDLT

TEGKLTWGKGTATSSFNIRAWGNSDSRKQVFECVDESGWHWYTQRPGGPGTSAIEFAINGT

VKPQAIHTGGNILLNGADIEFRRTGNKHLWFRDPNGLELGLIYCDDNGVIRFRGQKQGQDWV

FANKMIQLGTASTVGGSGNGLIRGQVQGGAWAQWRDRAAGILVDCQQSTDSAHNIWKATH

WGKYHIAAMGVHVPSGTIGNAMARLNVNDANFDFSASGDMSAGRNGSFNDVYIRSDARLKI

NKEEYKENATDKVNRLTVYTYDKVKSLTDRTVIAHEVGIIAQDLEKELPEAVTTSKIGDPDKPE

EILTISNSAVNALLIKAFQEMSEELKAVKAELAELKK

WW55-G8 (FIG. 10)

(SEQ ID NO: 139)
*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*__GAIINL__SCPPVYDRDVTMAGKVKGNNYILSKTANYLEDQTARDLNYFGA

-continued

FRTNGLDGLLELTLNVPHSSGVQHGRGFTFQYGHTGSRVETYGYNKEGQKAFSYKMYHEGD

KPTPGELNVYSKQEIDRMFVKNVKMVVPSGGATRGYFKIASAMIPQSGRMAFLRIYGGNGYN

VNSYDQVDFLEIVIRSGNNNPKGVSIAAYRRNSLNVHEVFAINTSGDNYDIYVNYGRFTDNVIVE

FGKTVDVALTVHDVPEFSATKPETGTKFDARVITMFNTENKAGTLMFDNNNQLTYDIVSLSNG

PDDVRNYLRKFRSKAGEMIWHETVQGAVYRLATGTTDSTEVLRVDSNSALPGSYKGYVITGK

MELHGSGSAMNLHRQTGQAAYMAWWDRRDGKNQRSGYIGHADGTTDGFVWRNDVGANS

FDLESSGQVNLTTGKTKIVYTNGQYYSANSDAFRMIYGNYGAFWRNDGGKVYLLSTAENDRF

GGWNGNRPFIYDLSTGKVTLGGDGNEGALVLERDSRAARFSNSVFLEKGLLTFSAGGNQSM

DSFTINHWGNSNAGRYNVLQFEDTKGTHFTTERNADGGLLAHFRGDLTTEGKLTVVGKGTAT

SSFNIRAWGNSDSRKQVFECVDESGWHWYTQRPGGPGTSAIEFAINGTVKPQAIHTGGNILL

NGADIEFRRTGNKHLWFRDPNGLELGLIYCDDNGVIRFRGQKGQDWVFANKMIQLGTASTV

GGSGNGLIRGQVQGGAWAQWRDRAAGILVDCQQSTDSAHNIWKATHWGKYHIAAMGVHVP

SGTIGNAMARLNVNDANFDFSASGDMSAGRNGSFNDVYIRSDARLKINKEEYKENATDKVNR

LTVYTYDKVKSLTDRTVIAHEVGIIAQDLEKELPEAVTTSKIGDPDKPEEILTISNSAVNALLIKA

FQEMSEELKAVKAELAELKKN

WW55-gp38                                                                                    (SEQ ID NO: 140)
MAISSGVVVGSSAVSETGQRWMSAAMQAVRLGRPAYMSAMVGRSKEIHYSIGASNSYNKDTLI

NWMKAQGSTPVVITITGNIVSQSTGVPCLDFPSSLTNEYVTLIINSGVHVLGRGGNNGGSNSAGG

AGGNAINNGIGTRLRINNNGIIGGGGGGGAGARYNPFPQMDMKFGGGGGRPFGAAGAAGGG

AAAASAGTISAPGKGTVSGVHYGGDGGDLGAAGKSSYIKGGTGGTVHSGGAAGKAVTGNAPR

WDKVGTIYGARV

WW55 gp57A                                                                                   (SEQ ID NO: 141)
MSNQHEQMINVLKVRLFDTQEKAAFLEGQLKDRERVLMELVRILGIQPDENGTVSLDAIVEEVK

ALLPKDEAAEDAEEEVELITEA

WW34 3.0                                                                                     (SEQ ID NO: 142)
*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*__TPGEL__NVYSKQEIDRMFVKNVKMSTPSGEATRGYFKIASAMIPQSGRM

AFLRIYGGNGFNVSYDQVDFLEIVIRSGNNNPKGVSIAAYRRNSLNVHEVFAINTSGDNYDIY

VNYGRFTDNVIVEFGKTVDVALTVHDVPEFSATKPETGTKFDARVITMFNTENKAGTLMFDNN

NQLTYDIVSLSNGPDDVRNYLRKFRSKAGEMIWHETVQGAVYRLATGTTDSTEVLRVDSNSAI

PGSYKGYVITGKMELHGSGNSMILHRQTAQAAYMSWWDRRDGKNQRSGYIGHADGTSDAIV

WNNDIGQNSAVLETSGQISFRTGATKIVYTNGQYYSANSDAYRMIFGNYGAFWRNDGTKVYL

LSTAENDKYGGWNAYRPFIYDLTSGNVQLGGDGNEDALTLECASRAARFSNDVYIKKGLLTF

DAGRAGSRDYIRFNHWGDSNNARDNVLCIEDSQGRHFSTERAMGTGALKAYFLGDLEVGGK

FTWGKNTATSSFNIRAWGNSDSRKQVLECADESGWHWYTQRTGGPDTSAIDFAINGTVRPQAI

HTGGNITINGADIEFKRTGNKHIWFRDPNGLELGLMYCDDAGAIRFRGQKQAQAWKFADKMI

-continued

QLESGTVSGGGNGLIRGEVAGGSWASWRDRAAGLMVGCPQSTNSAHNVWKATHWGKYHI

AAMAVHVPDGTITNALARLNVHDANFDFSASGDLSAGRNGSFNDVYIRSDARLKINKEEYKE

NATDKVNRLTVYTYDKVKSLTDRTVIAHEVGIIAQDLEKELPEAVTTSKIGDPDKPEEILTISNS

AVNALLIKAFQEMSEELKAVKAELAELKKN

WW34 gp38
(SEQ ID NO: 143)
MAISSGWVGSSAVSETGQRWMSAAMQAVRLGRPAYMSAMVGRSKEIHYSIGASNSYNKDTLI

NWMKAQGSTPVVITITGNIVSQSTGVPCLDFPSSLTNEYVTLIINPGVHVWGRGGNGGNNSAG

GAGGNAINNGIGTRLRITNNGAICGGGGGGGGGYYSPFSQMRLTFGGGGGRPFGAAGGSAN

MEQGATAGTISAPGKGSVNGVYNGGNGGDAGGAGGKCNIRGQGSEYNGGAAGKAVTGNAP

RWDKVGTIYGARV

WW34 gp57A
(SEQ ID NO: 144)
MSNQHEQMINVLKVRLFDTQEKAAFLEGQLKDRERVLMELVRILGIQPDENGTVSLDAIVEEVK

ALLPKDEAAEDAEEEVELITEA

WW14-G8
(SEQ ID NO: 145)
MAVKISGVLKDGTGKPVQNCTIQLKARRNSTTVVVNTVGSENPDEAGRYSMDVEYGQYSVILQ

VDGFPPSHAGTITVYEDSQPGTLNDFLCAMTEDDARPEVLRRLELMVEEVARNASVVAQSTAD

AKKSAGDASASAAQVAALVTDATDSARAASTSAGQAASSAQEASSGAEAASAKATEAEKSAA

AAESSKNAAATSAGAAKTSETNAAASQQSAATSASTAATKASEAATSARDAVASKEAAKSSET

NASSSAGRAASSATAAENSARAAKTSETNARSSETAAERSASAAADAKTAAAGSASTASTKAT

EAAGSAVSASQSKSAAEAAAIRAKNSAKRAEDIASAVALEDADTTRKGIVQLSSATNSTSETLAA

TPKAVKVVMDETNRNQIIDLGFAKGGQVDGDVTINGTLNLNGPEIVASGGYIEFNYRTTGSGS

WAGQHAAKAPIFVDLSAALSTSEYNPLFKQRYKDGTFSAGTLVTEGSFKFHYINEAGDSKYW

TFNRNGNFQVDTGSLFVSGGNISASGNINSASGFVSAPQINTKNIILDTKAFGQYDSQSLVNYV

YPGTGETNGVNYLRKVRAKSGGTMWHELCTAQLGQADEMSVVWTGNTPQSKQYGVRNDGR

LIGRNSLALGTMTTDFPSSDYGNTGAMGDKYLVLGDTATGLKYIKQGNFDLVGGGYSVASITT

DGFRGTSKTLFGRSNDQGLTWLLPGQNSAMVSIRTEIDGNNSGDGQTHLGYNSNGKLYHYF

RGTGRVAISMAEGMIIEPGILNIKTGVNELNLRADGTVSTTQRLMVNNGLVLNANNNTSALALT

APTGVDGTKTINWDAGTRNGQNKNTVTMKAWGNSFNAGGGNRETVFEVSDSQGYYFYGQR

TNPASGETVGPINFKFNGSVETGHFSSLGNISASGTGSFGGNVTMTNGLFVQGGASINGQVK

MGGTADALRIWNAEYGMIFRRSETGSSASFHLIPTLQNAGENGGISDLRPLSINLASGTVIMG

NKSTGGPLFTVDNVSKFVQTDCRLRVNMDSDGIVLNASSQAASNFIQGRKADVTKWYLGIGD

GGNVVRMHNYTYSHGIALNSDTVDITKPLKIGSDIRIGTDGNIIGSATLDNFKNLNTTLDHKVNM

GGWSGGATTGWYKFATVEIPQATGTASFKIFGGSGFNFKSYGQASIAEIILRTGNNNPKGLNA

TLWNRTSEAISQIASVNTSEDIYDIYVYLGGYSNSLVVEYTCSSNSKVTVVGMDGGVQPLVETL

PEGHVVGKSVRMLNNLDGMFAAGESDIVTRGEYVTNNQKGMRIKSKGNDLDSNAALLRNDG

GSFYILATDKNTTEKPDAANGDWNGLRPFSINMADGRVGMNHGLNITGGGLNVTGGNTNLG

NITSRVVSSARAGSGWGDNSDAMKSKITFMADHGDLSNSGSYYPIVGAYSNYGSAGYRQTF

EFGWVGSGSTANWREGIIRIRGDNANGQQARWRFTMDGILGCPGKVEMPETSAFGINTTNGF

GGNSIVIGDSDTGFRQVGDGLLEVWTNASRRMRFQGGDTYSDMNINAPNVYIRSDIRLKSNFK

PIENALDKVEQLDGLIYDKADYIGGEVVHTEAGVIAQSLEKVLPEAVREVDDIKGNKVLTVSTQ

AQVALLIEAVKTLSAKVKELEAKLN

WW14 gp38

(SEQ ID NO: 146)

MAIVGVPGWIGQSAVDETGQRVVMDAAMRDVRVAVPGWMGSMAGQSKEIYLSIGANNSYDRN

SLINWMRAQGGAPVVITITGNLVSNSTGNACLEFPSNLPNAYIQLIINSGVTVYGRGGNGSTNG

SAGGNGGTAIHNAAGTKLRIRNNGAIAGGGGGGGAVSLQNSYPTNGTCGGGGGRPFGVGGKI

GSDAILSGSNASLTAAGTGGATVQYGGGNGGNVGAGGGRGWGKNVYTSAGGSAGAAVTGN

APNWQNVGTIYGSRV

WW14 gp57A (SEQ ID NO: 147)

MSEQTIEQKLQAEIVALKSRILDTQDVAAQAQQESRILQDALSKIAARLGITGDQIQIEDLIAAVPD

LTAESADEE

WW170-G8

(SEQ ID NO: 148)

*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*__GAIINL__SCPPVYDRDVTMAGKVKGNNYILSKTANYLEDQTARDLNYFGA

FRTNGQDGLLDLTLNVPHSAGVNHGRGFTFRYATGGSRVETYGYNAQGQKAFSYKMYHEG

DKPTPSELNVYSKQEVDRMFVKTVKLATVPVDIVDGYFKLATAMIPQNGRSVFFRIHGGNGYN

VTAYDQVDIVEIVIRSGNNRPKGVNVIAYRRNTNKAFDVLAVNTSGDNYDIYVKYQRYTDNVIV

EFGKSVDVDLVVHDVPDFVVDRPVGDNVIGGRAVTLFNTENKRGVLSFDDNTQNSYDIVHLS

NDRGTGRKYIRKFRSNYNEMIWHETVQGSTYRLATGSTDAQEILSVESSSSIAGTHKGNILSG

RMMLGGGSNVITLRRPAGQSNHIAFQDNRTGSITRQGWIGYGNADTNVFEWYSDVGGTSIRH

HIDGQIELATGNTKRVYTNAQFISMNSDAYRMIFGNYGAFWRNDGTKVYLLSTAEDDKFGGW

NGNRPFIYDLTNGKVTLGGDGNEGALVLERDSRAARFAGDVYVEKGFLHFSSGRQGASGFM

KINHLGDIASGRHNILQIEDPTGIHFSTERNDETGNITARFKGFVRVEAGEIAFDANRGSQSQFT

LHTWGNEQRKQVFECKDATGYHVVYTERTQGGTGNVLFSMAGSLNVTSNITTTGADITFKRA

GNKHIWFRDPDGLELGLMYCDDAGAIRFRGQKQAQAWKFADKMIQLESGTVSGGGNGLIRG

EVAGGSWSSWRDRAAGLMVGCPQSTNSAHNVWKATHWGKYHIAAMGIHVPDGTIGNALAR

LHVHDTNFDFSASGDMTAGRNGSFNDVYIRSDARLKINKEEYKENATDKINRLTVYTYDKVKS

LTDRTVIAHEVGIIAQDLEKELPEAVTTSKVGDPDKPEEILTISNSAVNALLIKAFQEMSEELKA

VKAELAELKKN

WW170 gp38

(SEQ ID NO: 149)

MAISSGWVGSSAVSETGQRWMSAAMQAVRLGRPAYMSAMVGRSKEIHYSIGASNSYNKDTLI

NWMKAQGSTPVVITITGNIVSQSTGVPCLDFPSSLTNEYVTLIINPGVHVWGRGGNGGNNSAG

GAGGGNAINNGIGTRLRITNNGAICGGGGGGGGYYSPFSQMRLTFGGGGGRPFGAAGGSAN

MEQGATAGTISAPGKGSVNGVYNGGNGGDAGGAGGKCNIRGQGSEYNGGAAGKAVTGNAP

RWDKVGTIYGARV

WW170 gp57A (SEQ ID NO: 150)

MSNQHEQMINVLKVRLFDTQEKAAFLEGQLKDRERVLMELVRILGIQPDENGTVSLDAIVEEVK

-continued

ALLPKDEAAEDAKEEVELITEA

WW202-G8

(SEQ ID NO: 151)

*MAVKISGVLKDGTGKPVQNCTIQLKARRNSTTVVVNTVGSENPDEAGRYSMDVEYGQYSVILQ*

*VDGFPPSHAGTITVYEDSQPGTLNDFLCAMTEDDARPEVLRRLELMVEEVARNASVVAQSTAD*

*AKKSAGDASASAAQVAALVTDATDSARAASTSAGQAASSAQEASSGAEAASAKATEAEKSAA*

*AAESSKNAAATSAGAAKTSETNAAASQQSAATSASTAATKASEAATSARDAVASKEAAKSSET*

*NASSSAGRAASSATAAENSARAAKTSETNARSSETAAERSASAAADAKTAAAGSASTASTKAT*

*EAAGSAVSASQSKSAAEAAAIRAKNSAKRAEDIASAVALEDADTTRKGIVQLSSATNSTSETLAA*

*TPKAVKVVMDETNR*<u>GQIVN</u>LSCPPVYDKGFDVRGRVVVDDLWSNTANYFDDPTARNLDKF

GAFRTNDMDGHLAFALHIPHPSGINHARGFDFTYGSNVVPTVKTYGYNADGVLAYSYRMYHE

GDKPSPSELNVYSKQEVDRMFQKTINFGVETGWFKIATAFIPQNDGRSLKIRLVGGNGWNVG

QTGQCNIIELVIRTSNGSPKGINFVAYHHVSGYENQFCAINTGDDTYDIYAYYYEFTNMVMAEY

QASSDVNLTVFDRPEYVGEKPVAEHIFDAYTIHSFNSFSNRGTLNFAGNHQGQYDIEHMNEQP

TNAKKMLRRFRSSASATIWHETVDDQNYRLATGGTDSVQQLLLSSGTGLHIRRLTIDGGLGS

GSNAGIDIRRGPNESSHFNFMDYRTGQDVRNGWFGFGDLTTKDFIWWNDNGQNSINLIENGE

LHITGGRGQKIVMNSEVALSENARLAVKGGNYGLILRNDTGFHILTTDLKDSFGSWNNRRPF

SYNFADGGLYLGGTETARCLHLGIDGSTRLEDNLFFKAGSRQSMDYMELVHWGASNTGRNN

VLSLRDSKGFLAEFERVGGTDGVKTRFFGETFTDGTLYLNQMNNSSERFSINNWGNSEVGRA

AVMEVGDSKGYHFYAERRTDDTVLFDVSGALTVHGPNGITVKNSTGARHIWFRDDSDTEKAV

IWATDDGMLHIRNNHEGSFAHHFQGAMIKLEGRVPYGAAKGLIRGEVDGGAYVAWRDRPAG

LLVDCQKSIDSAHAVWKAVDWGRQYIAAMDVHCPGDGNNTAAAVLHVQAADYQFHASGEF

HASGNGNFNDVYIRSDRRLKDNIEDYTGNALSLIGKLKVKTYDKVKSLKDREIIGHEIGIIAQDL

QEILPEAVKSSKVGNLDNPDDVLTISNSAVNALLIKAIQEMSEEIKELKTPFFTKIARKISKYFKF

WW202 gp38

(SEQ ID NO: 152)

MAVVGVPGWIGSSAANETGQRWMSQAAGQLRLGVPCWMSQFSGRSREIIHTLGADHNFNGQ

WFRDRCFEAGSTPIVFNITGDLVSYSKDVPLFFMYGDTPNEYVQLNIHGVTMYGRGGNGGSNS

PGSAGGHCIQNDIGGRLRINNGGAIAGGGGGGGGGYYSPFSQMRLTFGGGGGRPFGAPGGS

IDMQSGATAGTLYAPGSGSVNGIYNGGSGGEVGAAGGRCNIRGQGYEYNGGDAGYAVIGSSP

TWQNRGAIYGPAV

WW202 gp57A (SEQ ID NO: 153)

MSNQHEQMINVLKVRLFDTQEKAAFLEGQLKDRERVLMELVRVLGIQPDENGTVSLDAIVEEVK

ALLPKDEAAEDAKEEVELITEA

In italics: Lambda N-terminal part and Underlined: T4-like DTF part

Chimeras Nucleotide Sequence

WW13 13.0

(SEQ ID NO: 154)

ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

-continued

```
GAGGATGATGCCCGGCCGGAGGTGCTGCGTCGTCTTGAACTGATGGTGGAAGAGGT
GGCGCGTAACGCGTCCGTGGTGGCACAGAGTACGGCAGACGCGAAGAAATCAGCCG
GCGATGCCAGTGCATCAGCTGCTCAGGTCGCGGCCCTTGTGACTGATGCAACTGACT
CAGCACGCGCCGCCAGCACGTCCGCCGGACAGGCTGCATCGTCAGCTCAGGAAGCG
TCCTCCGGCGCAGAAGCGGCATCAGCAAAGGCCACTGAAGCGGAAAAAAGTGCCGC
AGCCGCAGAGTCCTCAAAAAACGCGGCGGCCACCAGTGCCGGTGCGGCGAAAACGT
CAGAAACGAATGCTGCAGCGTCACAACAATCAGCCGCCACGTCTGCCTCCACCGCG
GCCACGAAAGCGTCAGAGGCCGCCACTTCAGCACGAGATGCGGTGGCCTCAAAAGA
GGCAGCAAAATCATCAGAAACGAACGCATCATCAAGTGCCGGTCGTGCAGCTTCCT
CGGCAACGGCGGCAGAAAATTCTGCCAGGGCGGCAAAAACGTCCGAGACGAATGC
CAGGTCATCTGAAACAGCAGCGGAACGGAGCGCCTCTGCCGCGGCAGACGCAAAAA
CAGCGGCGGCGGGGAGTGCGTCAACGGCATCCACGAAGGCGACAGAGGCTGCGGG
AAGTGCGGTATCAGCATCGCAGAGCAAAGTGCGGCAGAAGCGGCGGCAATACGTG
CAAAAAATTCGGCAAAACGTGCAGAAGATATAGCTTCAGCTGTCGCGCTTGAGGAT
GCGGACACAACGAGAAAGGGGATAGTGCAGCTCAGCAGTGCAACCAACAGCACGT
CTGAAACGCTTGCTGCAACGCCAAAGGCGGTTAAGGTGGTAATGGATGAGACTAAT
CGTAAGGCACCTCTGGACAGTCCGGCACTGACCGGAACGCCAACAGCACCAACCGC
GCTCAGGGGAACAAACAATACCCAGATTGCGAACACCGCTTTTGTACTGGCCGCGA
TTGCAGATGTTATCGACGCGTCACCTGACGCACTGAATACGCTGAATGAACTGGCCG
CAGCGCTCGGGAATGATCCAGATTTTGCTACCACCATGACTAACGCGCTTGCGGGTA
AACAACCGAAGAATGCGACACTGACGGCGCTGGCAGGGCTTTCCACGGCGAAAAAT
AAATTACCGTATTTTGCGGAAAATGATGCCGCCAGCCTGACTGAACTGACTCAGGTT
GGCAGGGATATTCTGGCAAAAAATTCCGTTGCAGATGTTCTTGAATACCTTGGGGCC
GGTGAGAATTCGATCATCCAGTTAGAAGATAGTCAAGGCGCCCATTTTTCCACTGAA
CGTACTTTAGCGACAGGTGCAATTAAAACTCGTTTCTTTGGCGAAACATTTACTGAT
GGTACATTATACCTAAATCAGATGAATAATAGTTCTGAACGATTCTCTATTAATAAT
TGGGGAAATTCAGAAGTTGGTCGCCCGGCAGTGTTGGAAGTCGGTGATTCCAAAGG
TTATCACTTCTATACGGAACGCGGGACAGATAACAGTTTGAATTTTGATGTTGCTGG
CAATTTTACTGTGCATGGACCTTCCGGGATTACTATCAAAACCTCTACTGGTGCTCGC
CATATCTGGTTTAGAGATGATAGCGATGCAGAAAAGGCTGTTATCTGGGCTACAGAT
GAGGGTATTTTACATATACGAAATAATTATGGGGGTTCATTTAGTCATCACTTCCAG
GGTGCAATGATTCTAGCGGGAGAGCGTGTTCCATATAATAGTGAATACGCTCTTATC
CGTGGTAATATTTCCGGTGGTGCATGGGTAGACTGGCGAGGTCGTCCGGCTGGATTG
TTGGTAGACTGTCAGGACTCACGAAATCAAGCATATAACATTTGGAAAGCTACTCAT
TGGGGCGACCAGCACCTTGCGGCGATGGGTGTTCATGCTGGCGGTGGTAATCCTCAG
GTTGTATTGCATGTGGGTGGGAATGATTATGCATTTGCATCTAACGGTGATTTTACTG
CTGGTGCTGCTGTATATTGTAACGACGTTTATATTCGTTCTGACCGTCGTCTGAAAAT
TAATGTTAAAGACTACGAAGAGAATGCGGTGGATAAGGTAAATAAACTCAAAGTTA
AAACCTATGATAAAGTTAAATCTCTTTCTGACCGCGAAGTTATCGGCCATGAGATTG
GTATTATCGCACAGGATTTGCAAGAAGTATTACCGGAAGCTGTTAGCACTTCTAGTG
```

-continued

TCGGATCTCAGGATAACCCAGAAGAAATTTTAACAATTTCTAACTCTGCTGTGAACG

CGCTTTTAATTAAGGCTATTCAGGAAATGAGTGAAGAAATTAAAGAATTGAAAACG

CCTCTCTTTACTAAAATTGCTCGCAAAATTAGTAAATATTTTAAATTCTAA

WW13 10.0

(SEQ ID NO: 155)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTGTTGACCGAGCAGTTCACACCCTTGGCGAAATCACTACAAATGCTGTTAATGGT

CTTCGTATTTGGAATAATGATTATGGAGTCATTTTTAGACGTTCAGAAGGAAGTCTT

CATATTATTCCTACCGCATTTGGTGAAGGAGAAACCGGTGATATTGGACCTTTACGT

CCTCTCAGTATAGCTTTAGATACCGGTAAAGTTACTATTCCGGATTTACAATCAAGTT

ACAATACGTTCGCTGCTAACGGTTATATTAAATTTGTTGGTCATGGAGCGGGGCCG

GCGGTTATGACATTCAATATGCTCAAGCGGCTCCTATTTTCCAGGAAATCGATGATG

ATGCTGTAAGCAAATATTATCCTATTGTTAAACAGAAGTTTTTAAACGGTAAATCCG

TTTGGTCTTTAGGTACCGAAATTGAATCAGGTACATTCGTTATTCATCATCTGAAAG

AAGATGGTTCACAAGGCCATGCGTCTCGTTTTAATCAAGACGGTACTGTTAACTTCC

CGGATAACGTTCTGGTCGGCGGTGATATTAACATGAAAGGCATGATGACTTTTGACG

CCGGACGTTTAGGATCACGAGATTATTTTAAATTTAACCATTGGGGTGATAGTAATA

ATGGTCGTGATAACATCATCCAGTTAGAAGATAGTCAAGGCGCCCATTTTTCCACTG

AACGTACTTTAGCGACAGGTGCAATTAAAACTCGTTTCTTTGGCGAAACATTTACTG

ATGGTACATTATACCTAAATCAGATGAATAATAGTTCTGAACGATTCTCTATTAATA

ATTGGGGAAATTCAGAAGTTGGTCGCCCGGCAGTGTTGGAAGTCGGTGATTCCAAA

GGTTATCACTTCTATACGGAACGCGGGACAGATAACAGTTTGAATTTTGATGTTGCT

-continued

```
GGCAATTTTACTGTGCATGGACCTTCCGGGATTACTATCAAAACCTCTACTGGTGCT
CGCCATATCTGGTTTAGAGATGATAGCGATGCAGAAAAGGCTGTTATCTGGGCTACA
GATGAGGGTATTTTACATATACGAAATAATTATGGGGGTTCATTTAGTCATCACTTC
CAGGGTGCAATGATTCTAGCGGGAGAGCGTGTTCCATATAATAGTGAATACGCTCTT
ATCCGTGGTAATATTTCCGGTGGTGCATGGGTAGACTGGCGAGGTCGTCCGGCTGGA
TTGTTGGTAGACTGTCAGGACTCACGAAATCAAGCATATAACATTTGGAAAGCTACT
CATTGGGGCGACCAGCACCTTGCGGCGATGGGTGTTCATGCTGGCGGTGGTAATCCT
CAGGTTGTATTGCATGTGGGTGGGAATGATTATGCATTTGCATCTAACGGTGATTTT
ACTGCTGGTGCTGCTGTATATTGTAACGACGTTTATATTCGTTCTGACCGTCGTCTGA
AAATTAATGTTAAAGACTACGAAGAGAATGCGGTGGATAAGGTAAATAAACTCAAA
GTTAAAACCTATGATAAAGTTAAATCTCTTTCTGACCGCGAAGTTATCGGCCATGAG
ATTGGTATTATCGCACAGGATTTGCAAGAAGTATTACCGGAAGCTGTTAGCACTTCT
AGTGTCGGATCTCAGGATAACCCAGAAGAAATTTTAACAATTTCTAACTCTGCTGTG
AACGCGCTTTTAATTAAGGCTATTCAGGAAATGAGTGAAGAAATTAAAGAATTGAA
AACGCCTCTCTTTACTAAAATTGCTCGCAAAATTAGTAAATATTTTAAATTCTAA
```

WW13-G8
(SEQ ID NO: 156)
```
ATGGCAGTAAAGATTTCAGGAGTCCTGAAAGACGGCACAGGAAAACCGGTACAGAA
CTGCACCATTCAGCTGAAAGCCAGACGTAACAGCACCACGGTGGTGGTGAACACGG
TGGGCTCAGAGAATCCGGATGAAGCCGGGCGTTACAGCATGGATGTGGAGTACGGT
CAGTACAGTGTCATCCTGCAGGTTGACGGTTTTCCACCATCGCACGCCGGGACCATC
ACCGTGTATGAAGATTCACAACCGGGGACGCTGAATGATTTTCTCTGTGCCATGACG
GAGGATGATGCCCGGCCGGAGGTGCTGCGTCGTCTTGAACTGATGGTGGAAGAGGT
GGCGCGTAACGCGTCCGTGGTGGCACAGAGTACGGCAGACGCGAAGAAATCAGCCG
GCGATGCCAGTGCATCAGCTGCTCAGGTCGCGGCCCTTGTGACTGATGCAACTGACT
CAGCACGCGCCGCCAGCACGTCCGCCGGACAGGCTGCATCGTCAGCTCAGGAAGCG
TCCTCCGGCGCAGAAGCGGCATCAGCAAAGGCCACTGAAGCGGAAAAAAGTGCCGC
AGCCGCAGAGTCCTCAAAAAACGCGGCGGCCACCAGTGCCGGTGCGGCGAAAACGT
CAGAAACGAATGCTGCAGCGTCACAACAATCAGCCGCCACGTCTGCCTCCACCGCG
GCCACGAAAGCGTCAGAGGCCGCCACTTCAGCACGAGATGCGGTGGCCTCAAAAGA
GGCAGCAAAATCATCAGAAACGAACGCATCATCAAGTGCCGGTCGTGCAGCTTCCT
CGGCAACGGCGGCAGAAAATTCTGCCAGGGCGGCAAAAACGTCCGAGACGAATGC
CAGGTCATCTGAAACAGCAGCGGAACGGAGCGCCTCTGCCGCGGCAGACGCAAAAA
CAGCGGCGGCGGGGAGTGCGTCAACGGCATCCACGAAGGCGACAGAGGCTGCGGG
AAGTGCGGTATCAGCATCGCAGAGCAAAGTGCGGCAGAAGCGGCGGCAATACGTG
CAAAAAATTCGGCAAAACGTGCAGAAGATATAGCTTCAGCTGTCGCGCTTGAGGAT
GCGGACACAACGAGAAGGGGATAGTGCAGCTCAGCAGTGCAACCAACAGCACGT
CTGAAACGCTTGCTGCAACGCCAAAGGCGGTTAAGGTGGTAATGGATGAGACTAAT
CGTGGAAATATTATTGATCTGGGTTTTGCTAAAGGCGGTAGTATTGACGGAAATGTT
ATTCATATAGGAAATTATAATCAAACTGGTGATTATACTTTAAATGGCACCTTCACT
CAGACAGGTAATTTTAATTTAACTGGTATTGCTCGAGTAACTCGCGATATTATTGCC
```

-continued

```
GCCGGGCAAATTATGACTGAGGGCGGAGAACTTATTACAAAAAGTTCAGGTACAGC

ACATGTTCGTTTTTTCGATGGCAATAGCCGCGAACGTGGAATCATTTATGCCCCGGC

CAATGATGGTTTAACTACGCAAGTTCTTAATATCAGGGTTCAAGACTACGCCGCTGG

TAGCGAAAGCACTTATGCATTTTCAGGCAGTGGCCTATTTACTTCACCTGAAGTATC

GGCATGGAAATCTATGTCAACTCCTCAGATTTTGACCGATAAAGTTATTACAAATGG

GAAGAAGACAGGCGATTATGATATCTATTCATTATCAAATAACACTCCATTGGCAGA

AAGCGAAACGGCTATTAACCACCTCCGTGTTATGCGAAATGCTGTAGGAGCAGGTA

TTTTCCACGAAGTTAATGTTAATGACGGAATAACCTGGTATTCCGGAGATGGCTTAG

ACACTTATCTTTGGTCGTTTAACTGGGCCGGTGGATTGAAAGCTGGTCATTCTATTTC

TGTAGGTCTTCCGGGTGGCTCTAAAGGATATTCTGAATTAGGAACGGCCTCAATTGC

TCTTGGTGATAATGACACCGGATTTAAATGGCATCAGGACGGATATTTTCATACAGT

AAACAATGGAACAAGAACTTTCATCTACGGCCCTGCGGAAACACAAAGCCTTAGAA

AAATGGTTATGGGTTATTCTCCGGACGGGATTCTTATGACAACGCCACCGACAGAAA

ACTATGCTCTTGCTACTGTAGTGACATACCACGATAATAACGCGTTTGGAGATGGTC

AAACTCTTTTAGGATATTATCAAGGCGGTAACTATCATCACTATTTCCGCGGTAAGG

GTACTACAAACATTAATACTCATGGCGGTTTGTTAGTTACTCCAGGCAATATTGACG

TTATTGGTGGTTCTGTTAATATCGATGGTAGAAATAATAATTCAACTTTAATGTTTAA

AGGCTATACCATGGGTCAAAGCTCCGTTGATAACATGTATATAGCTGTTTGGGGAAA

TACATTTACTAATCCTAGTGAAGGCACCCGTAAAAATGTCATGGAAATTTCTGATGA

TATTGGATGGATGCATTATATTCAACGAAATAAAGATAATACAGTTGAAGCCGTATT

AAATGGTCAACAGACAATTAACGAAAATATTATTGCGAAAAAGGATATTTGGGTTG

ACCGAGCAGTTCACACCCTTGGCGAAATCACTACAAATGCTGTTAATGGTCTTCGTA

TTTGAATAATGATTATGGAGTCATTTTTAGACGTTCAGAAGGAAGTCTTCATATTA

TTCCTACCGCATTTGGTGAAGGAGAAACCGGTGATATTGGACCTTTACGTCCTCTCA

GTATAGCTTTAGATACCGGTAAAGTTACTATTCCGGATTTACAATCAAGTTACAATA

CGTTCGCTGCTAACGGTTATATTAAATTTGTTGGTCATGGAGCGGGGGCCGGCGGTT

ATGACATTCAATATGCTCAAGCGGCTCCTATTTTCCAGGAAATCGATGATGATGCTG

TAAGCAAATATTATCCTATTGTTAAACAGAAGTTTTTAAACGGTAAATCCGTTTGGT

CTTTAGGTACCGAAATTGAATCAGGTACATTCGTTATTCATCATCTGAAAGAAGATG

GTTCACAAGGCCATGCGTCTCGTTTTAATCAAGACGGTACTGTTAACTTCCCGGATA

ACGTTCTGGTCGGCGGTGATATTAACATGAAAGGCATGATGACTTTTGACGCCGGAC

GTTTAGGATCACGAGATTATTTTAAATTTAACCATTGGGGTGATAGTAATAATGGTC

GTGATAACATCATCCAGTTAGAAGATAGTCAAGGCGCCCATTTTTCCACTGAACGTA

CTTTAGCGACAGGTGCAATTAAAACTCGTTTCTTTGGCGAAACATTTACTGATGGTA

CATTATACCTAAATCAGATGAATAATAGTTCTGAACGATTCTCTATTAATAATTGGG

GAAATTCAGAAGTTGGTCGCCCGGCAGTGTTGGAAGTCGGTGATTCCAAAGGTTATC

ACTTCTATACGGAACGCGGGACAGATAACAGTTTGAATTTTGATGTTGCTGGCAATT

TTACTGTGCATGGACCTTCCGGGATTACTATCAAAACCTCTACTGGTGCTCGCCATAT

CTGGTTTAGAGATGATAGCGATGCAGAAAAGGCTGTTATCTGGGCTACAGATGAGG

GTATTTTACATATACGAAATAATTATGGGGGTTCATTTAGTCATCACTTCCAGGGTG

CAATGATTCTAGCGGGAGAGCGTGTTCCATATAATAGTGAATACGCTCTTATCCGTG
```

-continued

```
GTAATATTTCCGGTGGTGCATGGGTAGACTGGCGAGGTCGTCCGGCTGGATTGTTGG

TAGACTGTCAGGACTCACGAAATCAAGCATATAACATTTGGAAAGCTACTCATTGGG

GCGACCAGCACCTTGCGGCGATGGGTGTTCATGCTGGCGGTGGTAATCCTCAGGTTG

TATTGCATGTGGGTGGGAATGATTATGCATTTGCATCTAACGGTGATTTTACTGCTG

GTGCTGCTGTATATTGTAACGACGTTTATATTCGTTCTGACCGTCGTCTGAAAATTAA

TGTTAAAGACTACGAAGAGAATGCGGTGGATAAGGTAAATAAACTCAAAGTTAAAA

CCTATGATAAAGTTAAATCTCTTTCTGACCGCGAAGTTATCGGCCATGAGATTGGTA

TTATCGCACAGGATTTGCAAGAAGTATTACCGGAAGCTGTTAGCACTTCTAGTGTCG

GATCTCAGGATAACCCAGAAGAAATTTTAACAATTTCTAACTCTGCTGTGAACGCGC

TTTTAATTAAGGCTATTCAGGAAATGAGTGAAGAAATTAAAGAATTGAAAACGCCT

CTCTTTACTAAAATTGCTCGCAAAATTAGTAAATATTTTAAATTCTAA

WW13 GP38
                                                (SEQ ID NO: 157)
ATGGCAGTAGTTGGAGTTCCTGGCTGGATTGGAAGTTCAGCCGTAAATGAAACGGG

TCAGCGCTGGATGAGTCAAGCAGCTGGTCAATTAAGATTGGGTGTTCCTTGCTGGAT

GAGTCAATTTGCAGGTCGCTCAAGAGAAATTATTCATACACTTGGAGCAGACCATAA

CTTCAATGGTCAATGGTTCCGAGATAGATGTTTTGAGGCAGGTAGTACACCTATAGT

GTTTAATATCACTGGAGATTTAGTATCATATTCTAAAGATGTTCCTTTATTCTTCATG

TACGGAGATACACCGAATGAATATGTTCAACTGAATATACACGGCGTAACGATGTA

TGGACGTGGCGGTAATGGCGGTAGCAATAGTCCTGGTTCAGCTGGAGGTCATTGTAT

TCAAAACGATATTGGTGGGAGACTAAGAATTAATAACGGTGGAGCTATTGCCGGCG

GCGGCGGTGGCGGCGGTGGCGGTAGATATGGCAGACTATCATTTGGTGGTGGCGGT

GGTCGCCCATTCGGTGCTGGCGGGTCTTCCTCTCATATGAGTTCCGGTGCAACTGCT

GGCACCATTTCCGCTCCGGGTGCAGGATCTGTCGGTGAGGGATCTCTTTGGGTATAT

ACAGGCGGTTCGGGTGGTAATGTCGGTGCTGCTGGAGGAAGATGTAATATTCAAGG

TAACGGTACAGAATATGATGGCGGTGCTGCTGGTTATGCTGTTATAGGGTCTGCTCC

AACTTGGATAAATGTTGGAGCAATATATGGTCCAAGAGTATAA

WW13 GP57A
                                                (SEQ ID NO: 158)
ATGTCTGAACAAACTATTGAACAAAAACTGTCTGCTGAAATCGTAACTCTGAAGTCT

CGTATCCTTGATACGCAGGACCAAGCGGCTCGTCTGATGAAGAATCCAAAATTCTG

CAAGGAACTTTGGCTGAAATTGCTCGTGCAGTAGGTATCACTGGCGATACTATCAAA

GTTGAAGAAATCGTTGAAGCTGTCAAGAATCTTACTGCTGAATCTGCAGATGAAGCA

AAAGATGAAGAATGA

PP-1
                                                (SEQ ID NO: 159)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG
```

-continued

```
GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAAGGCACCTCTGGACAGTCCGGCACTGACCGGAACGCCAACAGCACCAACCGC

GCTCAGGGGAACAAACAATACCCAGATTGCGAACACCGCTTTTGTACTGGCCGCGA

TTGCAGATGTTATCGACGCGTCACCTGACGCACTGAATACGCTGAATGAACTGGCCG

CAGCGCTCGGGAATGATCCAGATTTTGCTACCACCATGACTAACGCGCTTGCGGGTA

AACAACCGAAGAATGCGACACTGACGGCGCTGGCAGGGCTTTCCACGGCGAAAAAT

AAATTACCGTATTTTGCGGAAAATGATGCCGCCAGCCTGACTGAACTGACTCAGGTT

GGCAGGGATATTCTGGCAAAAAATTCCGTTGCAGATGTTCTTGAATACCTTGGGGCC

GGTGAGAATTCGATCGCTACCCGCGTGTCCAAAGAAGGTGACACTATGACTGGTAA

GCTGACTCTGTCTGCGGGTAACGATGCGCTGGTGCTGACTGCGGGCGAGGGCGCGTC

CTCGCACATTCGCTCTGACGTGGGCGGGACGAACAACTGGTATATCGGTAAAGGCA

GTGGGGATAACGGTTTAGGCTTCTACTCATACATCACTCAGGGCGGGGTGTATATTA

CCAACAACGGGGAAATCGCTTTAAGCCCGCAGGGTCAGGGTACGTTTAACTTCAAC

CGTGATCGTCTGCACATCAACGGCACGCAATGGACGGCACATCAAGGCGGTGGCTG

GGAAAACCAGTGGAATCAGGAAGCGCCGATTTTTATTGATTTCGGCAACGTGGGCA

ATGATAGCTACTACCCGATTATCAAAGGTAAGTCCGGCATTACCAACGAAGGTTATA

TTTCTGGCGTGGACTTCGGTATGCGTCGGATTACTAACACGTGGGCGCAGGGTATTA

TCCGCGTAGGCAATCAGGAAAACGGTAGCGATCCGCAGGCCATCTACGAGTTCCAT

CATAATGGCGTACTGTACGTTCCTAATATGGTAAAAACGGGTGCGCGTCTGAGCGCA

GGTGGGGGGATCCGGTATGGCAGGGTGCATGTGTTGTTATCGGTGACAATGACAC

GGGCTTAGTGCATGGTGGCGATGGTCGCATCAATATGGTTGCAAACGGTATGCACAT

TGCGTCTTGGAGTTCCGCGTATCATTTACATGAGGGTTTATGGGATACTACGGGCGC

GTTATGGACGGAGCAAGGGCGTGCAATTATCAGCTTCGGTCATCTGGTACAACAAA

GCGATGCCTATTCCACCTTTGTCCGTGATGTATACGTTCGTTCGGATATTCGCGTTAA

AAAAGATCTGGTGAAATTCGAAAACGCTAGCGAAAAACTGTCCAAAATCAACGGTT

ATACTTATATGCAGAAACGCGGGTTAGACGAAGAAGGTAATCAGAAATGGGAGCCT

AACGCCGGATTAATCGCGCAGGAAGTGCAGGCGATTCTGCCGGAACTGGTAGAAGG

CGATCCGGACGGTGAAGCATTATTACGTCTGAACTACAATGGCGTGATCGGCCTGAA
```

-continued

TACTGCGGCGATTAATGAACATACGGCAGAGATCGCGGAGCTGAAAAGCGAGATTG

AAGAACTGAAAAAAATTGTCAAAAGCCTGTTAAAGTAA

PP-1 GP38

(SEQ ID NO: 160)
ATGGCAGTAACAGGACCGTGGGTAGGATCGTCTGCAGTAGTTAATACAGGACAAAA

TTGGATGGTCGGCGCGGCCCAACGATTAAGAATGGGTGCTCCGTTCTGGATGAGCA

ACATGATTGGGCGCTCTGTTGAAGTGATTCATACGTTAGGCGCAGATCATAATTTTA

ATGGTCAATGGTTTCGTGACCGTTGCTTTGAGGCGGGCAGTGCGCCGATCGTGTTTA

ACATCACTGGCGATTTAGTTTCTTACTCCCGTGACGTTCCGCTGTTTTTCATGTATGG

TGACACGCCGAACGAGTATGTACAATTAAACATTCACGGTGTCACGATGTACGGGC

GCGGGGCAACGGTTGGGCGGCGGGTGCAATCGGTGCGAGCGATGGCGGGGTGTGC

ATCCAGAATGATATTGGAGGCCGACTGCGTATCAACAATGGTGGGGCAATCGCGGG

CGGTGGCGGTGGTGGGGGTGGTTATTCTCAGGCTAACAATTGGGCAGGTAAGTACG

TTTGCGGTGGCGGTGGCGGTCGTCCGTTCGGCTTAGGTGGCAACAACGGTGCGCGTT

GGCCTGGGGGCAACGCTAGCCTGACCTCGCCGGGCGCAGGTGGGAACACTGGCACG

CGTTATTACGCTGGCGGGGGAGGTGAGGTTGGTCAGCCGGGTCAGTATGCAAACCC

CGGCGCGGGTTACTCCACCCCACCAACGTCGCCGGGCGCGGCAGTTGCAGGTAGTG

CGCCAACTTGGCAAAACGTGGGCGCTATTTATGGCCCGCGTGTTTAA

PP-1 GP57A (SEQ ID NO: 161)
ATGAGTGAACAGACCATCGAACAAAAATTAAGCGCGGAAATCGTGACTCTGAAAAG

TCGCATTCTGGATACTCAGGACCAGGCAGCACGTCTGATGGAAGAGTCTAAAATCTT

GCAGGGCACTCTGGCAGAAATTGCCCGTGCGGTGGGTATCACAGGCGACACGATCA

AAGTAGAAGAAATTGTGGAGGCCGTAAAGAATCTCACAGCGGAGAGCACCGATGA

AGCAAAAGACGAAGAATAA

WW55 3.0

(SEQ ID NO: 162)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

-continued

```
CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTACTCCAGGAGAATTGAACGTCTATAGCAAACAAGAAATTGACCGTATGTTTGTT

AAGAACGTTAAAATGGTTGTTCCTTCTGGTGGTGCAACCCGTGGTTATTTTAAAATT

GCATCCGCAATGATCCCGCAGAGTGGTCGGATGGCGTTTCTGCGAATCTATGGTGGT

AATGGATATAATGTAAACTCATATGATCAAGTTGATTTTCTTGAAATTGTGATTCGT

AGTGGTAATAATAACCCTAAAGGCGTTAGTATTGCTGCATATCGTCGAAATTCTTTG

AACGTCCATGAAGTATTTGCAATTAATACTTCCGGTGATAACTATGACATTTATGTT

AACTATGGTCGCTTCACCGATAACGTTATTGTAGAGTTTGGAAAAACTGTTGACGTC

GCATTGACTGTTCATGATGTTCCTGAATTTTCGGCGACTAAACCAGAAACCGGAACT

AAATTTGATGCTCGTGTTATTACGATGTTCAACACCGAAAACAAAGCCGGAACATTG

ATGTTTGATAATAACAATCAGTTAACCTATGATATTGTTAGCCTTAGCAATGGTCCT

GATGATGTTAGAAATTATCTGCGTAAATTCCGAAGTAAAGCGGGTGAAATGATTTGG

CATGAAACCGTTCAGGGTGCTGTATATCGTCTTGCTACTGGAACTACTGATTCTACG

GAAGTTCTTAGAGTTGATTCTAACAGTGCTCTCCCGGGTAGCTATAAAGGATATGTA

ATTACTGGTAAAATGGAATTGCACGGTAGCGGTAGTGCGATGAATTTACACCGCCA

GACTGGTCAAGCTGCATATATGGCGTGGTGGGATCGTCGTGATGGTAAAAACCAAC

GTAGCGGTTATATCGGTCATGCGGATGGTACTACTGATGGTTTTGTGTGGCGTAATG

ATGTTGGTGCGAACTCATTTGATTTGGAAAGTAGTGGACAAGTAAATTTGACTACAG

GAAAAACAAAAATTGTATATACCAACGGACAATATTATTCCGCTAACTCTGATGCAT

TCCGTATGATTTACGGCAATTATGGCGCATTCTGGCGAAATGATGGTGGTAAAGTTT

ATCTGTTGTCTACTGCCGAAAATGATAGATTTGGTGGATGGAACGGCAACCGACCAT

TCATTTACGACCTGTCAACTGGTAAAGTTACTTTAGGTGGCGACGGTAACGAAGGCG

CATTAGTTCTCGAAAGAGATAGCCGTGCGGCTAGATTTAGCAACAGCGTATTCTTAG

AAAAAGGATTGCTTACTTTCTCTGCGGGTGGGAATCAGTCAATGGATTCTTTCACGA

TTAACCATTGGGGGAATAGTAACGCTGGACGATATAATGTTTTACAATTTGAAGACA

CGAAAGGAACACATTTTACAACCGAACGTAATGCTGATGGTGGATTGCTTGCTCACT

TCCGAGGGGATTTAACCACAGAAGGGAAATTAACGTGGGGTAAGGGTACAGCCACA

TCTAGCTTTAACATTCGTGCATGGGTAATAGTGATTCCCGTAAACAGGTTTTCGAG

TGTGTAGATGAAAGTGGTTGGCATTGGTATACCCAGCGACCGGGCGGTCCTGGTACT

TCTGCAATTGAGTTTGCCATCAATGGTACTGTTAAGCCTCAAGCAATTCACACTGGC

GGTAATATTCTTTTGAACGGTGCTGATATTGAGTTTCGTCGCACTGGTAATAAGCATT

TGTGGTTTAGAGATCCAAACGGATTAGAATTGGGTTTGATTTATTGTGATGACAACG

GTGTCATTCGTTTTCGTGGTCAGAAACAAGGTCAAGATTGGGTATTTGCCAATAAGA

TGATCCAATTAGGGACCGCTTCTACTGTTGGTGGATCTGGTAACGGTTTGATTCGCG

GACAAGTTCAAGGTGGTGCTTGGGCACAATGGAGAGACCGTGCTGCTGGAATCCTT

GTAGACTGTCAGCAATCTACTGATTCCGCTCATAACATCTGGAAAGCGACTCATTGG

GGAAAATATCATATTGCGGCAATGGGTGTACACGTTCCTAGCGGCACTATAGGTAAT
```

-continued

GCTATGGCACGTCTAAACGTAAATGACGCCAACTTTGACTTTAGCGCCTCCGGTGAC

ATGTCGGCAGGGCGTAACGGTTCGTTTAACGATGTTTATATTCGTTCTGATGCTCGCC

TTAAAATCAATAAGGAAGAGTATAAAGAGAATGCCACCGATAAAGTTAATCGCTTA

ACTGTATACACCTATGACAAGGTTAAATCTTTAACCGACCGTACTGTCATTGCTCAT

GAAGTTGGCATTATCGCACAGGATCTTGAGAAAGAATTGCCGGAAGCAGTAACAAC

CTCGAAGATCGGCGATCCAGATAAACCAGAAGAGATCTTAACAATTTCTAACTCTGC

TGTCAACGCTCTTTTAATTAAGGCGTTTCAGGAAATGAGCGAAGAATTGAAAGCCGT

TAAAGCTGAACTAGCGGAACTTAAAAAGTAA

WW55-G8

(SEQ ID NO: 163)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTGGTGCTATTATCAATTTAAGTTGTCCTCCTGTTTATGACCGCGATGTTACAATGG

CGGGTAAGGTTAAAGGTAATAATTATATCTTAAGTAAAACCGCTAACTATCTGGAAG

ATCAGACAGCGAGAGATCTTAACTACTTTGGCGCTTTCCGTACCAATGGTCTTGATG

GTCTTCTCGAACTCACGCTAAACGTTCCTCACTCTTCCGGTGTCCAACATGGTCGAG

GATTTACTTTCCAGTATGGGCACACTGGATCGCGTGTAGAAACTTATGGCTATAATA

AGAAGGTCAAAAAGCATTTAGTTATAAAATGTATCACGAAGGTGATAAACCAACT

CCAGGAGAATTGAACGTCTATAGCAAACAAGAAATTGACCGTATGTTTGTTAAGAA

CGTTAAAATGGTTGTTCCTTCTGGTGGTGCAACCCGTGGTTATTTTAAAATTGCATCC

GCAATGATCCCGCAGAGTGGTCGGATGGCGTTTCTGCGAATCTATGTGGTAATGGA

TATAATGTAAACTCATATGATCAAGTTGATTTTCTTGAAATTGTGATTCGTAGTGGTA

-continued

```
ATAATAACCCTAAAGGCGTTAGTATTGCTGCATATCGTCGAAATTCTTTGAACGTCC
ATGAAGTATTTGCAATTAATACTTCCGGTGATAACTATGACATTTATGTTAACTATG
GTCGCTTCACCGATAACGTTATTGTAGAGTTTGGAAAAACTGTTGACGTCGCATTGA
CTGTTCATGATGTTCCTGAATTTTCGGCGACTAAACCAGAAACCGGAACTAAATTTG
ATGCTCGTGTTATTACGATGTTCAACACCGAAAACAAAGCCGGAACATTGATGTTTG
ATAATAACAATCAGTTAACCTATGATATTGTTAGCCTTAGCAATGGTCCTGATGATG
TTAGAAATTATCTGCGTAAATTCCGAAGTAAAGCGGGTGAAATGATTTGGCATGAA
ACCGTTCAGGGTGCTGTATATCGTCTTGCTACTGGAACTACTGATTCTACGGAAGTT
CTTAGAGTTGATTCTAACAGTGCTCTCCCGGGTAGCTATAAAGGATATGTAATTACT
GGTAAAATGGAATTGCACGGTAGCGGTAGTGCGATGAATTTACACCGCCAGACTGG
TCAAGCTGCATATATGGCGTGGTGGGATCGTCGTGATGGTAAAAACCAACGTAGCG
GTTATATCGGTCATGCGGATGGTACTACTGATGGTTTTGTGTGGCGTAATGATGTTG
GTGCGAACTCATTTGATTTGGAAAGTAGTGGACAAGTAAATTTGACTACAGGAAAA
ACAAAAATTGTATATACCAACGGACAATATTATTCCGCTAACTCTGATGCATTCCGT
ATGATTTACGGCAATTATGGCGCATTCTGGCGAAATGATGGTGGTAAAGTTTATCTG
TTGTCTACTGCCGAAAATGATAGATTTGGTGGATGGAACGGCAACCGACCATTCATT
TACGACCTGTCAACTGGTAAAGTTACTTTAGGTGGCGACGGTAACGAAGGCGCATTA
GTTCTCGAAAGAGATAGCCGTGCGGCTAGATTTAGCAACAGCGTATTCTTAGAAAA
AGGATTGCTTACTTTCTCTGCGGGTGGGAATCAGTCAATGGATTCTTTCACGATTAA
CCATTGGGGAATAGTAACGCTGGACGATATAATGTTTTACAATTTGAAGACACGA
AAGGAACACATTTTACAACCGAACGTAATGCTGATGGTGGATTGCTTGCTCACTTCC
GAGGGGATTTAACCACAGAAGGGAAATTAACGTGGGGTAAGGGTACAGCCACATCT
AGCTTTAACATTCGTGCATGGGTAATAGTGATTCCCGTAAACAGGTTTTCGAGTGT
GTAGATGAAAGTGGTTGGCATTGGTATACCCAGCGACCGGGCGGTCCTGGTACTTCT
GCAATTGAGTTTGCCATCAATGGTACTGTTAAGCCTCAAGCAATTCACACTGGCGGT
AATATTCTTTTGAACGGTGCTGATATTGAGTTTCGTCGCACTGGTAATAAGCATTTGT
GGTTTAGAGATCCAAACGGATTAGAATTGGGTTTGATTTATTGTGATGACAACGGTG
TCATTCGTTTTCGTGGTCAGAAACAAGGTCAAGATTGGGTATTTGCCAATAAGATGA
TCCAATTAGGGACCGCTTCTACTGTTGGTGGATCTGGTAACGGTTTGATTCGCGGAC
AAGTTCAAGGTGGTGCTTGGGCACAATGGAGAGACCGTGCTGCTGGAATCCTTGTA
GACTGTCAGCAATCTACTGATTCCGCTCATAACATCTGGAAAGCGACTCATTGGGGA
AAATATCATATTGCGGCAATGGGTGTACACGTTCCTAGCGGCACTATAGGTAATGCT
ATGGCACGTCTAAACGTAAATGACGCCAACTTTGACTTTAGCGCCTCCGGTGACATG
TCGGCAGGGCGTAACGGTTCGTTTAACGATGTTTATATTCGTTCTGATGCTCGCCTTA
AAATCAATAAGGAAGAGTATAAAGAGAATGCCACCGATAAAGTTAATCGCTTAACT
GTATACACCTATGACAAGGTTAAATCTTTAACCGACCGTACTGTCATTGCTCATGAA
GTTGGCATTATCGCACAGGATCTTGAGAAAGAATTGCCGGAAGCAGTAACAACCTC
GAAGATCGGCGATCCAGATAAACCAGAAGAGATCTTAACAATTTCTAACTCTGCTGT
CAACGCTCTTTTAATTAAGGCGTTTCAGGAAATGAGCGAAGAATTGAAAGCCGTTAA
AGCTGAACTAGCGGAACTTAAAAAGAATTAA

>WW55 GP38
```

-continued (SEQ ID NO: 164)
ATGGCAATATCTTCTGGATGGGTAGGATCATCTGCTGTGTCCGAGACTGGTCAACGG

TGGATGAGCGCCGCAATGCAAGCTGTTCGCTTAGGTCGTCCGGCGTATATGTCGGCA

ATGGTCGGACGCTCTAAAGAGATTCATTATAGCATTGGTGCTAGTAACTCTTACAAT

AAAGACACTCTTATTAACTGGATGAAAGCACAAGGATCTACTCCGGTAGTAATTACT

ATCACGGGTAATATTGTTTCCCAATCTACTGGCGTTCCTTGTCTTGATTTCCCTAGCT

CACTGACAAACGAATATGTAACACTCATTATTAACTCTGGTGTTCATGTATTAGGTC

GTGGAGGAAATGGCGGAAGTAACTCTGCTGGTGGAGCAGGAGGAAATGCAATAAAT

AACGGAATTGGAACTCGTTTAAGAATAAACAATAATGGTATTATTGGTGGTGGCGGT

GGTGGCGGTGCTGGTGCTAGATACAATCCTTTCCCTCAAATGGATATGAAATTTGGC

GGCGGTGGAGGCCGTCCATTTGGTGCTGCGGGTGCGGCAGGAGGCGGCGCAGCGGC

AGCATCTGCTGGTACAATTTCTGCCCCAGGTAAAGGCACTGTTTCTGGGGTTCATTA

TGGAGGAGATGGTGGAGATTTGGGAGCTGCTGGCAAATCTTCATATATTAAAGGTG

GTACTGGTGGAACTGTTCACTCGGGTGGTGCTGCGGGTAAAGCTGTTACTGGTAATG

CCCCTCGCTGGGATAAAGTAGGCACGATCTACGGTGCTCGCGTG

WW55 GP57A
(SEQ ID NO: 165)
ATGTCCAATCAGCATGAACAAATGATTAATGTCCTGAAAGTACGTCTGTTTGACACT

CAAGAAAAGGCCGCATTCTTAGAAGGCCAACTGAAAGATCGTGAGCGTGTATTGAT

GGAACTGGTACGCATTCTGGGTATTCAGCCAGACGAAAACGGCACTGTTTCCCTTGA

TGCTATTGTCGAAGAAGTGAAAGCACTTCTCCCTAAAGACGAAGCAGCGGAAGACG

CAGAAGAGGAAGTAGAACTGATCACGGAGGCTTGA

WW34 3.0
(SEQ ID NO: 166)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

```
GCGGACACAACGAGAAAGGGGATAGTGCAGCTCAGCAGTGCAACCAACAGCACGT
CTGAAACGCTTGCTGCAACGCCAAAGGCGGTTAAGGTGGTAATGGATGAGACTAAT
CGTACTCCAGGAGAATTGAACGTCTATAGCAAACAAGAAATTGACCGTATGTTGTT
AAGAACGTTAAAATGTCTACTCCTTCTGGTGAAGCAACCCGTGGTTATTTTAAAATT
GCATCCGCAATGATCCCGCAGAGTGGTCGGATGGCGTTTCTGCGAATCTATGGTGGG
AACGGATTTAATGTTAACTCCTACGATCAGGTGGATTTCCTTGAAATTGTGATTCGT
AGTGGTAATAATAACCCTAAAGGCGTTAGTATTGCTGCATATCGTCGAAATTCTTTG
AACGTCCATGAAGTATTTGCAATTAATACTTCCGGTGATAACTATGACATTTATGTT
AACTATGGTCGCTTCACCGATAACGTTATTGTAGAGTTTGGAAAAACTGTTGATGTT
GCATTGACTGTTCACGATGTTCCTGAATTTTCGGCGACTAAACCAGAAACCGGAACT
AAATTTGATGCTCGTGTTATTACGATGTTCAACACCGAAAACAAAGCCGGAACGTTG
ATGTTTGATAATAACAATCAGTTAACCTATGATATTGTTAGCCTTAGCAATGGTCCT
GATGATGTTAGAAATTATCTGCGTAAATTCCGAAGTAAAGCGGGTGAAATGATTTGG
CATGAAACAGTTCAGGGTGCTGTATATCGTCTTGCTACTGGAACTACTGATTCTACG
GAAGTTCTTAGAGTTGATTCTAATAGTGCTATACCAGGTAGCTATAAAGGATATGTA
ATTACTGGTAAAATGGAATTGCATGGTAGTGGTAATTCGATGATTTTACATCGCCAG
ACTGCTCAAGCCGCGTACATGTCGTGGTGGGATCGTCGTGATGGCAAAAACCAACG
TAGCGGTTATATCGGTCATGCAGATGGGACTAGTGATGCTATTGTGTGGAATAATGA
TATTGGACAAAACAGTGCTGTTCTAGAAACATCTGGTCAAATATCTTTCAGAACAGG
TGCAACCAAAATTGTATATACCAACGGACAATATTATTCCGCTAACTCTGATGCATA
CCGTATGATCTTTGGTAATTACGGTGCATTCTGGCGTAATGACGGCACTAAAGTTTA
TCTTCTTTCTACTGCTGAAAATGATAAGTATGGTGGATGGAATGCCTATCGTCCATTC
ATTTATGATTTAACTTCCGGTAACGTTCAATTAGGCGGTGATGGTAACGAAGATGCA
TTAACGTTAGAATGTGCTTCTCGTGCCGCTCGCTTTAGTAATGACGTTTACATTAAGA
AAGGGCTTTTGACTTTCGACGCTGGGCGCGCTGGATCTCGCGATTATATTCGATTTA
ATCATTGGGGTGATAGTAATAATGCCCGTGATAACGTTTTGTGCATAGAAGATAGTC
AAGGCCGACATTTTAGCACAGAACGTGCGATGGGTACTGGTGCTCTTAAAGCATACT
TCTTAGGCGATCTTGAAGTCGGTGGTAAGTTTACTTGGGGTAAAAATACAGCTACAT
CTAGCTTTAATATTCGTGCATGGGGTAATGATTCCCGTAAACAAGTATTAGAATGCG
CGGATGAAAGTGGGTGGCATTGGTACACACAACGAACGGGCGGTCCTGATACTTCT
GCAATTGATTTTGCCATCAATGGTACTGTTAGGCCTCAAGCAATTCACACTGGCGGT
AATATCACTATCAACGGTGCTGATATTGAGTTTAAACGCACTGGCAATAAGCACATC
TGGTTTAGAGATCCGAACGGTTTAGAGTTAGGCTTGATGTACTGCGATGATGCTGGT
GCTATTCGCTTCCGTGGTCAGAAACAAGCCCAGGCGTGGAAATTTGCAGATAAAAT
GATCCAGTTGGAATCTGGCACTGTATCCGGTGGCGGTAATGGCCTGATTCGTGGTGA
AGTTGCTGGCGGTAGTTGGGCTAGCTGGCGTGACCGTGCTGCTGGTCTTATGGTTGG
GTGTCCTCAATCCACCAACTCGGCACATAACGTATGGAAAGCGACGCATTGGGGTA
AATATCACATTGCAGCAATGGCTGTACATGTTCCTGATGGTACTATTACCAATGCTTT
AGCTCGCCTAAACGTTCATGACGCCAACTTTGACTTTAGCGCCTCCGGTGACCTGTC
GGCAGGGCGTAATGGTTCGTTTAACGATGTTTATATTCGTTCTGATGCTCGCCTTAAA
ATCAACAAGGAAGAGTATAAGGAGAATGCCACCGATAAAGTTAATCGCTTGACGGT
```

-continued

ATACACCTATGACAAGGTTAAATCTTTAACCGACCGTACTGTCATTGCTCATGAAGT

TGGTATTATTGCTCAGGATCTTGAGAAAGAATTGCCGGAAGCAGTAACAACTTCTAA

GATCGGCGATCCTGATAAGCCAGAAGAGATCTTAACAATTTCTAACTCTGCTGTCAA

CGCTCTTTTAATTAAGGCGTTTCAGGAAATGAGCGAAGAATTGAAAGCCGTTAAAGC

TGAACTAGCGGAACTTAAAAAGAATTAA

WW34 GP38
(SEQ ID NO: 167)
ATGGCAATATCTTCTGGATGGGTAGGATCATCTGCGGTGTCCGAGACTGGTCAACGG

TGGATGAGCGCCGCAATGCAAGCTGTTCGCTTAGGTCGTCCGGCGTATATGTCGGCA

ATGGTCGGACGCTCTAAAGAGATTCATTATAGCATTGGTGCTAGTAACTCTTACAAT

AAAGACACTCTTATTAACTGGATGAAAGCACAGGGATCTACTCCGGTAGTAATTACT

ATCACGGGTAATATTGTTTCCCAATCTACTGGAGTTCCTTGTCTTGACTTCCCTAGCT

CGTTAACAAACGAATATGTAACATTGATCATTAACCCAGGTGTTCATGTTTGGGGGC

GTGGTGGTAATGGTGGCAATAACTCCGCTGGTGGCGCTGGTGGTAATGCAATTAACA

ACGGTATAGGCACACGCTTACGCATCACAAATAACGGCGCTATTTGCGGTGGTGGC

GGCGGCGGCGGCGGCGGGTATTATTCTCCTTTTTCACAAATGAGATTAACCTTTGGT

GGTGGCGGTGGGCGTCCGTTTGGTGCTGCCGGTGGGTCTGCTAATATGGAACAGGGT

GCTACTGCTGGTACTATTTCCGCGCCAGGTAAAGGGTCTGTAAACGGTGTATATAAT

GGCGGTAACGGTGGTGATGCTGGTGGTGCTGGTGGTAAATGTAATATCCGTGGACA

GGGATCGGAATATAACGGTGGTGCGGCTGGTAAGGCTGTTACTGGCAATGCCCCTC

GCTGGGATAAAGTAGGCACGATCTACGGTGCTCGCGTG

WW34 GP57A
(SEQ ID NO: 168)
ATGTCCAATCAGCATGAACAAATGATTAATGTCCTGAAAGTACGTCTGTTTGACACT

CAAGAAAAGGCCGCATTCTTAGAAGGCCAACTGAAAGATCGTGAGCGTGTATTGAT

GGAACTGGTACGCATTCTGGGTATTCAGCCAGACGAAAACGGCACTGTTTCCCTTGA

TGCTATTGTCGAAGAAGTGAAAGCACTTCTCCCTAAAGACGAAGCAGCGGAAGACG

CAGAAGAGGAAGTAGAACTGATCACGGAGGCTTGA

WW14-G8
(SEQ ID NO: 169)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

-continued

```
GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

CAGCGGCGGCGGGGAGTGCGTCAACGGCATCCACGAAGGCGACAGAGGCTGCGGG

AAGTGCGGTATCAGCATCGCAGAGCAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTAACCAGATTATTGATTTAGGCTTTGCAAAGGGTGGACAAGTTGACGGTGATGTA

ACTATTAACGGAACTCTGAATTTAAACGGCCCTGAAATTGTTGCCTCCGGTGGTTAT

ATAGAATTTAACTATCGTACGACAGGTAGTGGCTCTTGGGCGGGTCAGCACGCGGCC

AAAGCTCCTATTTTTGTTGATTTAAGTGCGGCGTTATCTACTTCAGAATACAACCCAC

TGTTTAAGCAGCGTTACAAAGATGGAACATTTTCAGCAGGTACATTAGTTACTGAAG

GTAGTTTTAAATTTCACTATATTAATGAAGCTGGTGATTCGAAATATTGGACCTTTAA

TCGTAATGGTAATTTTCAAGTTGATACCGGTAGTTTATTTGTATCGGGTGGTAATATT

TCCGCTTCAGGCAATATCAACTCTGCCTCAGGGTTTGTGTCTGCGCCTCAGATTAATA

CTAAAAATATTATTTTAGATACAAAAGCATTTGGACAATACGACAGTCAGTCTTTAG

TTAATTACGTATACCCAGGCACCGGCGAAACAAATGGTGTAAACTATCTTCGTAAAG

TTCGTGCTAAATCCGGCGGCACTATGTGGCATGAGCTTTGCACTGCCCAATTAGGCC

AAGCCGATGAAATGTCTTGGTGGACAGGTAATACCCCTCAGTCTAAACAATACGGT

GTTCGTAACGACGGCCGTTTGATTGGTAGAAATAGCCTTGCATTAGGTACTATGACT

ACCGATTTCCCATCTAGCGATTATGGTAATACCGGAGCTATGGGTGACAAATACCTA

GTTTTAGGTGATACTGCAACCGGTTTAAAATATATCAAACAAGGCAATTTTGATTTA

GTTGGTGGTGGATATTCTGTTGCGTCAATTACCACAGACGGTTTCCGTGGCACAAGT

AAAACCTTATTTGGTCGTAGTAATGACCAAGGTTTAACATGGCTTCTTCCTGGTCAA

AACTCTGCAATGGTTTCTATCAGAACCGAAATAGATGGTAATAACTCTGGCGATGGC

CAAACCCATTTAGGTTATAATTCTAATGGTAAACTTTATCATTATTTCCGTGGTACCG

GTCGTGTAGCCATTTCTATGGCAGAAGGTATGATTATTGAACCTGGTATTTTAAATA

TTAAGACCGGGGTTAACGAATTAAATCTTAGAGCAGACGGCACAGTTTCTACTACAC

AGCGTTTAATGGTTAATAACGGCTTAGTTCTTAACGCAAACAATAATACTTCTGCAT

TGGCATTAACTGCTCCTACCGGTGTTGATGGTACAAAAACCATTAACTGGGACGCTG

GTACCCGAAATGGCCAGAACAAAAATACCGTTACCATGAAAGCATGGGGTAACTCA

TTTAACGCGGGTGGTGGTAATAGAGAAACTGTATTCGAAGTATCAGATTCACAAGG

ATATTATTTCTATGGCCAACGTACTAATCCGGCTTCCGGTGAAACTGTAGGCCCTATT

AACTTCAAGTTCAACGGTTCTGTTGAAACAGGTCATTTTCTAGTCTCGGAAATATA

AGTGCATCTGGTACCGGTTCTTTTGGTGGCAATGTTACCATGACTAATGGCCTGTTTG

TCCAAGGCGGCGCTTCAATTAATGGCCAAGTTAAAATGGGTGGTACTGCTGACGCAT

TAAGAATTTGGAACGCTGAATATGGTATGATTTTCCGTCGTTCAGAAACGGGTTCTT

CTGCTTCATTCCATCTTATTCCTACCCTTCAAAACGCCGGTGAAAATGGCGGAATAA

GTGACCTTCGTCCACTATCTATCAATTTAGCTAGCGGCACGTTATAATGGGTAATA

AAAGCACAGGTGGCCCACTTTTCACAGTAGACAACGTAAGTAAATTTGTTCAAACCG
```

-continued

```
ACTGTAGATTGCGTGTTAATATGGATTCTGATGGTATTGTTTTGAATGCTTCATCTCA

AGCAGCATCCAACTTTATTCAAGGACGTAAAGCAGATGTTACAAAATGGTATCTAG

GTATTGGCGATGGTGGCAACGTCGTTCGTATGCACAACTATACTTATTCACATGGTA

TTGCATTAAACTCTGATACCGTTGATATAACCAAGCCTCTTAAAATAGGTTCTGATA

TTCGTATCGGTACTGATGGGAATATTATAGGCAGTGCTACTTTAGATAACTTTAAAA

ACCTGAATACAACATTAGACCATAAAGTTAATATGGGCGGTTGGTCCGGCGGTGCTA

CTACAGGTTGGTATAAATTTGCTACTGTAGAAATTCCACAGGCAACAGGCACGGCAT

CTTTTAAAATATTTGGCGGTTCCGGGTTTAATTTTAAAAGTTACGGTCAGGCTTCAAT

AGCTGAAATAATTCTTAGAACCGGTAATAATAACCCTAAAGGCCTTAATGCCACGTT

GTGGAATAGGACTTCTGAAGCTATTTCCCAGATTGCTTCGGTTAATACAAGCGAAGA

TATCTATGATATTTACGTTTACTTAGGTGGGTATTCTAATTCTTTGGTGGTAGAATAT

ACCTGCAGCAGCAATAGTAAAGTAACCGTAGTAGGTATGGATGGTGGTGTCCAGCC

TTTGGTAGAAACATTACCTGAAGGTCATGTTGTAGGTAAATCTGTAAGAATGCTGAA

CAACCTTGACGGAATGTTTGCCGCTGGCGAATCGGATATTGTTACTCGTGGTGAATA

TGTTACCAATAACCAAAAAGGTATGCGTATTAAATCTAAAGGTAATGATTTAGATTC

TAATGCTGCTTTACTTAGAAACGACGGTGGAAGTTTTTATATTTTAGCTACAGATAA

AAATACGACAGAAAAACCCGATGCGGCTAATGGTGATTGGAATGGCTTAAGACCTT

TCTCGATTAATATGGCTGATGGTCGCGTTGGTATGAACCACGGATTGAATATTACTG

GCGGTGGTCTGAACGTTACCGGCGGTAATACTAACCTTGGTAATATTACATCTCGTG

TAGTTTCTTCGGCACGCGCCGGGTCCGGTTGGGGTGATAACTCTGATGCTATGAAAT

CCAAAATTACCTTTATGGCTGACCACGGTGATTTATCTAATTCAGGCAGTTATTATCC

TATCGTAGGCGCATACAGCAACTATGGTTCAGCGGGTTATCGTCAAACCTTTGAATT

TGGATGGGTCGGCTCTGGTAGCACCGCAAATTGGCGAGAAGGTATTATTCGTATTCG

CGGTGATAATGCTAACGGCCAGCAAGCAAGATGGCGCTTTACAATGGACGGTATTTT

AGGTTGCCCTGGTAAAGTAGAGATGCCAGAAACAAGCGCATTTGGTATCAACACAA

CAAATGGATTTGGTGGTAACTCGATTGTAATTGGTGATAGCGATACTGGTTTTAGAC

AAGTCGGTGATGGGCTTTTAGAAGTTTGGACTAACGCCTCACGCCGAATGAGATTCC

AAGGCGGTGATACCTATTCAGATATGAATATTAACGCCCCGAACGTTTATATTCGTT

CTGATATTCGTTTGAAATCTAACTTCAAACCGATTGAAAATGCTCTTGATAAGGTTG

AACAGCTAGACGGTTTAATCTATGATAAAGCTGATTATATTGGCGGCGAAGTTGTTC

ATACCGAGGCCGGTGTTATTGCTCAGAGTTTGGAAAAAGTATTGCCTGAAGCTGTCC

GTGAAGTTGACGACATTAAAGGTAACAAAGTTCTTACCGTTTCAACCCAGGCACAA

GTTGCTCTGTTAATTGAAGCAGTTAAAACTCTGTCGGCTAAAGTTAAAGAACTTGAA

GCAAAACTTAATTAA
```

WW14 GP38
(SEQ ID NO: 170)
```
ATGGCAATTGTAGGTGTTCCTGGTTGGATTGGACAATCTGCCGTAGATGAAACGGGA

CAACGTTGGATGGATGCCGCTATGCGCGATGTGCGAGTTGCAGTACCCGGTTGGATG

GGGTCGATGGCAGGACAATCAAAAGAAATTTATCTATCTATAGGGGCTAATAACTCT

TATGATAGAAACTCCCTTATTAACTGGATGAGGGCTCAAGGTGGCGCGCCTGTAGTT

ATTACAATCACCGGTAACTTAGTATCCAATAGCACCGGTAACGCTTGTTTGGAATTT
```

```
                                        -continued
CCTAGCAATCTTCCTAACGCGTATATTCAACTTATCATTAATAGCGGTGTGACTGTTT

ATGGCCGAGGAGGTAATGGTTCTACTAATGGTTCGGCAGGTGGAAACGGTGGTACA

GCTATCCATAACGCAGCCGGAACTAAACTCCGTATTCGTAATAACGGCGCTATTGCC

GGTGGTGGTGGTGGCGGTGGCGCAGTATCATTGCAAAATAGCTACCCGACTAATGG

TACATGCGGTGGTGGTGGTGGTAGACCATTTGGCGTAGGTGGTAAAATAGGCTCTGA

CGCTATATTGTCCGGTTCGAATGCGTCTTTAACAGCTGCCGGTACAGGTGGTGCTAC

AGTCCAATATGGTGGAGGTAATGGCGGTAACGTTGGAGCTGGCGGTGGACGAGGAT

GGGGCAAAAATGTTTATACCTCTGCAGGTGGCTCAGCTGGTGCTGCTGTCACTGGCA

ATGCTCCTAACTGGCAAAACGTAGGAACTATTTACGGCTCAAGAGTCTAG

WW14 GP57A
                                                  (SEQ ID NO: 171)
ATGTCTGAACAAACTATTGAACAAAAACTGCAAGCCGAAATCGTAGCTCTTAAATCC

CGCATTCTGGACACCCAGGATGTTGCAGCTCAAGCTCAACAGGAATCACGTATTCTG

CAGGATGCGCTGAGTAAAATCGCTGCTCGCTTAGGCATCACCGGTGACCAGATTCAG

ATTGAAGACCTGATTGCCGCTGTTCCTGATTTGACCGCTGAAAGTGCTGACGAAGAA

TAA

WW170-G8
                                                  (SEQ ID NO: 172)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

CAGCGGCGGCGGGGAGTGCGTCAACGGCATCCACGAAGGCGACAGAGGCTGCGGG

AAGTGCGGTATCAGCATCGCAGAGCAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTGGTGCTATTATCAATTTAAGTTGCCCTCCGGTGTATGACCGCGATGTTACAATG

GCGGGTAAGGTTAAAGGAAATAATTATATTTTAAGTAAAACCGCCAACTATCTGGA

AGATCAGACAGCGCGAGATCTTAATTACTTTGGTGCTTTCCGAACTAATGGACAAGA

TGGTCTTTTAGATCTAACTCTTAATGTTCCTCATTCTGCTGGCGTTAATCATGGTCGA
```

-continued

```
GGATTTACTTTCCGTTATGCGACTGGCGGATCTCGTGTTGAAACCTATGGGTATAAT

GCACAGGGACAAAAAGCATTTAGCTATAAAATGTATCATGAAGGTGATAAACCTAC

CCCATCGGAATTGAACGTTTATAGCAAACAAGAAGTTGACCGTATGTTTGTTAAAAC

CGTTAAACTTGCTACAGTTCCTGTTGATATCGTTGACGGTTATTTTAAATTAGCAACT

GCGATGATTCCGCAAAACGGTCGTAGCGTATTTTTCCGTATTCATGGTGGTAACGGA

TATAACGTTACTGCATACGATCAAGTTGATATTGTAGAAATTGTTATTCGCAGTGGA

AATAATCGTCCTAAAGGTGTTAACGTTATTGCATACCGCCGAAATACAAACAAAGC

ATTTGATGTTTTGGCTGTTAATACTTCTGGTGATAACTATGATATCTACGTGAAATAT

CAGCGTTACACTGATAACGTTATTGTTGAATTTGGTAAAAGTGTTGATGTTGATCTG

GTAGTCCATGACGTTCCAGACTTTGTTGTTGATCGTCCTGTTGGCGATAATGTTATTG

GCGGTCGCGCGGTAACTCTTTTCAACACCGAAAACAAACGAGGTGTGTTGAGTTTTG

ACGATAACACACAAAATAGTTATGATATTGTTCACTTGAGTAATGATAGGGGTACTG

GACGAAAATATATTCGTAAATTCCGTAGCAACTATAACGAAATGATCTGGCATGAG

ACGGTTCAAGGTTCTACTTATCGACTCGCCACGGGTAGCACAGATGCCCAGGAGATT

CTATCCGTTGAATCTAGTAGCTCTATTGCTGGAACTCATAAAGGTAATATTCTTTCTG

GTCGAATGATGTTGGGTGGCGGTAGTAATGTTATTACCTTGCGGCGTCCTGCTGGTC

AATCCAACCATATTGCGTTTCAAGATAATCGTACTGGATCTATTACCCGTCAAGGGT

GGATCGGTTATGGTAATGCTGATACTAACGTTTTTGAATGGTATAGTGATGTAGGTG

GTACTTCTATTCGTCACCACATCGACGGACAGATCGAACTTGCAACCGGTAACACAA

AACGCGTTTATACTAACGCTCAATTCATCTCAATGAATAGCGACGCCTACCGTATGA

TCTTTGGTAATTACGGTGCATTCTGGCGTAATGACGGCACTAAAGTTTATCTTCTTTC

TACTGCCGAAGATGATAAATTTGGCGGGTGGAATGGAAACAGACCGTTCATTTACG

ATTTGACCAACGGTAAAGTTACTTTAGGTGGTGATGGTAACGAAGGTGCATTAGTTC

TCGAAAGAGATAGCCGTGCTGCTCGATTTGCTGGTGATGTTTATGTAGAAAAAGGAT

TTCTTCATTTTTCTAGTGGGCGTCAGGGTGCTAGCGGTTTCATGAAAATAAACCATTT

GGGTGATATTGCCAGTGGACGACACAACATTCTTCAAATAGAAGACCCTACAGGTA

TACATTTCTCTACTGAACGCAATGATGAAACCGGAAATATTACTGCACGTTTTAAAG

GCTTTGTACGTGTAGAAGCTGGTGAAATTGCATTTGATGCTAATCGGGGTCGCAGT

CTCAATTTACCTTACACACATGGGGTAACGAGCAACGCAAACAGGTTTTTGAATGTA

AGGATGCTACAGGTTATCACTGGTATACTGAACGTACTCAGGGTGGCACTGGAAAT

GTTCTGTTCTCTATGGCTGGTAGTCTAAACGTTACTAGCAATATCACAACAACTGGT

GCTGATATTACGTTTAAACGCGCTGGCAATAAGCACATCTGGTTTAGAGATCCAGAC

GGTTTAGAGTTGGGCTTGATGTATTGCGATGATGCTGGTGCTATTCGCTTCCGTGGTC

AGAAACAAGCCCAGGCGTGGAAATTTGCAGATAAAATGATCCAGTTGGAATCTGGT

ACTGTATCTGGTGGCGGTAATGGCCTGATTCGTGGTGAAGTTGCTGGCGGTAGTTGG

TCTAGCTGGCGTGACCGTGCTGCTGGCCTTATGGTTGGGTGTCCTCAATCCACCAAC

TCGGCACATAACGTATGGAAAGCGACGCATTGGGTAAATATCACATTGCAGCAAT

GGGTATACATGTTCCTGACGGTACTATCGGTAACGCTCTTGCTCGTCTCCATGTTCAT

GATACTAACTTTGACTTTAGCGCCTCCGGTGATATGACGGCAGGTCGTAACGGTTCG

TTTAACGATGTGTATATTCGTTCTGATGCTCGCCTTAAAATCAATAAGGAAGAGTAT
```

-continued

AAAGAGAATGCCACCGATAAAATTAATCGCTTGACGGTATACACCTATGACAAGGT

TAAATCTTTAACCGACCGTACTGTCATTGCTCATGAAGTTGGTATTATTGCTCAGGAT

CTTGAAAAGAATTGCCGGAAGCAGTAACAACTTCTAAGGTCGGCGATCCTGATAA

GCCAGAAGAGATCTTAACAATTTCTAACTCTGCTGTCAACGCTCTTTTAATTAAGGC

GTTTCAGGAAATGAGCGAAGAATTGAAAGCCGTTAAAGCTGAACTAGCGGAACTTA

AAAAGAATTAA

WW170 GP38

(SEQ ID NO: 173)
ATGGCAATATCTTCTGGATGGGTAGGATCATCTGCGGTGTCCGAGACTGGTCAACGG

TGGATGAGCGCCGCAATGCAAGCTGTACGCTTAGGTCGTCCGGCGTATATGTCGGCA

ATGGTCGGACGCTCTAAAGAGATTCATTATAGCATTGGTGCTAGTAACTCTTACAAT

AAAGACACTCTTATTAACTGGATGAAAGCACAAGGATCTACTCCGGTAGTAATTACT

ATCACTGGTAATATTGTTTCCCAATCTACTGGCGTTCCTTGTCTTGACTTCCCTAGCT

CGTTAACAAACGAATATGTAACATTGATCATTAACCCCGGTGTTCATGTTTGGGGGC

GTGGTGGTAATGGTGGCAATAACTCCGCTGGTGGTGCTGGTGGTAATGCAATTAACA

ACGGTATAGGCACACGCTTACGCATCACAAATAACGGCGCTATTTGCGGTGGCGGT

GGCGGTGGCGGCGGTGGGTATTATTCTCCTTTTTCACAAATGAGATTAACCTTTGGC

GGTGGTGGTGGGCGTCCGTTTGGTGCTGCCGGTGGGTCTGCTAATATGGAACAGGGT

GCTACTGCTGGTACTATTTCCGCGCCAGGTAAAGGGTCTGTCAACGGTGTATATAAT

GGCGGTAACGGTGGTGATGCTGGTGGTGCTGGTGGTAAATGTAATATCCGTGGACA

GGGATCGGAATATAACGGTGGTGCGGCTGGTAAGGCTGTTACTGGCAATGCCCCTC

GCTGGGATAAAGTAGGCACGATCTACGGTGCTCGTGTGTAA

WW170 GP57A (SEQ ID NO: 174)
ATGTCCAATCAGCATGAACAAATGATTAATGTCCTGAAAGTACGTCTGTTTGACACT

CAAGAAAAGGCCGCATTCTTAGAAGGCCAACTGAAAGATCGTGAGCGTGTATTGAT

GGAACTGGTACGCATTCTGGGTATTCAGCCAGACGAAAACGGCACTGTTTCCCTTGA

TGCTATCGTCGAAGAAGTGAAAGCACTTCTCCCTAAAGACGAAGCAGCGGAAGACG

CTAAAGAGGAAGTAGAACTGATCACGGAGGCTTGA

WW202-G8

(SEQ ID NO: 175)
ATGGCAGTAAAGATTTCAGGAGTCCTGAAAGACGGCACAGGAAAACCGGTACAGAA

CTGCACCATTCAGCTGAAAGCCAGACGTAACAGCACCACGGTGGTGGTGAACACGG

TGGGCTCAGAGAATCCGGATGAAGCCGGGCGTTACAGCATGGATGTGGAGTACGGT

CAGTACAGTGTCATCCTGCAGGTTGACGGTTTTCCACCATCGCACGCCGGGACCATC

ACCGTGTATGAAGATTCACAACCGGGGACGCTGAATGATTTTCTCTGTGCCATGACG

GAGGATGATGCCCGGCCGGAGGTGCTGCGTCGTCTTGAACTGATGGTGGAAGAGGT

GGCGCGTAACGCGTCCGTGGTGGCACAGAGTACGGCAGACGCGAAGAAATCAGCCG

GCGATGCCAGTGCATCAGCTGCTCAGGTCGCGGCCCTTGTGACTGATGCAACTGACT

CAGCACGCGCCGCCAGCACGTCCGCCGGACAGGCTGCATCGTCAGCTCAGGAAGCG

TCCTCCGGCGCAGAAGCGGCATCAGCAAAGGCCACTGAAGCGGAAAAAAGTGCCGC

AGCCGCAGAGTCCTCAAAAAACGCGGCGGCCACCAGTGCCGGTGCGGCGAAAACGT

CAGAAACGAATGCTGCAGCGTCACAACAATCAGCCGCCACGTCTGCCTCCACCGCG

GCCACGAAAGCGTCAGAGGCCGCCACTTCAGCACGAGATGCGGTGGCCTCAAAAGA

-continued

```
GGCAGCAAAATCATCAGAAACGAACGCATCATCAAGTGCCGGTCGTGCAGCTTCCT

CGGCAACGGCGGCAGAAAATTCTGCCAGGGCGGCAAAAACGTCCGAGACGAATGC

CAGGTCATCTGAAACAGCAGCGGAACGGAGCGCCTCTGCCGCGGCAGACGCAAAA

CAGCGGCGGCGGGGAGTGCGTCAACGGCATCCACGAAGGCGACAGAGGCTGCGGG

AAGTGCGGTATCAGCATCGCAGAGCAAAAGTGCGGCAGAAGCGGCGGCAATACGTG

CAAAAAATTCGGCAAAACGTGCAGAAGATATAGCTTCAGCTGTCGCGCTTGAGGAT

GCGGACACAACGAGAAAGGGGATAGTGCAGCTCAGCAGTGCAACCAACAGCACGT

CTGAAACGCTTGCTGCAACGCCAAAGGCGGTTAAGGTGGTAATGGATGAGACTAAT

CGTGGGCAAATTGTTAATTTAAGTTGCCCTCCTGTTTATGACAAAGGCTTTGATGTA

AGAGGCCGCGTGGTTGTGGATGACCTTGTGTGGAGTAATACCGCAAACTATTTCGAT

GACCCGACCGCACGAAATCTTGATAAATTTGGGGCATTTCGTACTAATGATATGGAT

GGTCATCTAGCATTTGCTTTGCATATTCCCCATCCTAGCGGTATAAATCATGCTCGTG

GGTTTGATTTTACTTATGGTTCTAACGTTGTTCCTACTGTAAAAACCTATGGTTATAA

CGCTGATGGTGTATTGGCATATTCATATCGCATGTATCACGAAGGTGATAAGCCTAG

TCCGTCAGAATTAAATGTATACAGCAAACAAGAAGTAGATCGGATGTTCCAAAAAA

CCATCAACTTTGGTGTAGAAACTGGATGGTTTAAAATTGCTACAGCATTTATTCCGC

AAAATGATGGACGTAGCTTGAAAATTAGATTGGTTGGTGGAAATGGGTGGAACGTA

GGCCAAACGGGACAATGTAATATTATTGAACTTGTTATAAGGACTAGCAACGGTTCC

CCTAAAGGAATTAACTTTGTTGCATATCATCATGTTTCTGGTTACGAAAATCAATTTT

GTGCCATTAATACAGGTGATGACACTTATGATATCTATGCATACTACTACGAATTTA

CTAATATGGTAATGGCTGAATATCAAGCGTCCAGCGATGTTAATTTAACTGTATTTG

ATCGACCTGAATATGTAGGCGAAAAACCTGTAGCCGAACATATATTCGATGCATATA

CAATACACTCCTTTAACAGTTTCAGTAACCGTGGAACATTAAATTTTGCTGGCAACC

ATCAAGGACAATATGACATTGAGCATATGAACGAACAACCGACAAATGCTAAAAAG

ATGTTGCGTCGGTTTCGAAGCTCTGCCAGCGCGACAATCTGGCATGAAACCGTTGAT

GACCAGAATTATCGTCTTGCCACTGGAGGTACAGACTCAGTTCAACAATTATTGTTG

TCTTCTGGGACTGGTTTGCATATTCGTAGATTGACCATCGATGGTGGCTTAGGTTCCG

GTTCTAATGCTGGTATTGATATTCGTCGAGGACCAAACGAATCAAGCCATTTTAATT

TTATGGATTATCGCACTGGTCAAGATGTTCGTAATGGTTGGTTTGGTTTTGGTGATTT

GACGACCAAAGATTTTATTTGGTGGAACGATAACGGTCAAAACTCGATAAACTTGAT

CGAAAACGGTGAATTACATATTACTGGCGGTAGAGGCCAGAAAATTGTAATGAATA

GCGAAGTTGCATTATCTGAAAATGCTCGTTTGGCTGTCAAAGGTGGTAACTATGGTT

TAATCCTTCGTAATGATGGGACTGGTTTCCATATACTGACTACCGATTTAAAAGATT

CTTTTGGTAGTTGGAATAATCGCAGACCATTCAGCTATAATTTTGCGGACGGTGGAT

TATATTTAGGTGGTACTGAAACTGCTCGTTGTTTGCATCTTGGAATTGATGGTAGCAC

TCGTCTAGAAGACAACCTTTTCTTTAAAGCTGGTTCTCGTCAATCTATGGACTATATG

GAACTCGTCCATTGGGGGGCAAGCAATACAGGTCGAAATAACGTTTTAAGTCTTCGT

GACTCAAAAGGATTTTTAGCAGAATTTGAACGCGTGGGGGGGACTGACGGCGTTAA

AACCAGATTCTTTGGCGAAACATTCACTGACGGTACATTATACCTAAATCAGATGAA

TAATAGCTCTGAACGATTCTCTATCAATAACTGGGGAAATTCAGAAGTTGGTCGCGC
```

```
GGCAGTAATGGAAGTTGGCGATTCCAAAGGTTATCACTTCTATGCGGAACGTAGAA

CAGATGACACCGTTTTATTTGATGTATCTGGTGCTTTGACCGTGCATGGACCTAACG

GAATAACCGTCAAAAACTCAACTGGTGCACGCCATATCTGGTTTAGAGATGATAGC

GATACGGAAAAGGCTGTTATCTGGGCTACAGATGATGGTATGTTACATATACGAAAT

AATCATGAGGGTTCATTTGCTCATCACTTCCAGGGCGCAATGATTAAACTGGAAGGG

CGTGTTCCTTATGGTGCAGCAAAAGGGCTTATTCGAGGCGAGGTAGACGGTGGTGC

ATATGTTGCATGGAGAGATCGCCCTGCTGGTTTGTTGGTTGACTGCCAGAAAAGTAT

TGACAGTGCTCATGCTGTTTGGAAAGCGGTTGATTGGGGCGTCAATATATCGCTGC

TATGGACGTTCATTGTCCGGGTGATGGTAATAATACTGCGGCAGCGGTTCTTCATGT

TCAGGCTGCTGATTATCAATTCCATGCAAGCGGAGAATTTCATGCCTCTGGTAACGG

GAACTTTAACGATGTGTATATTCGTTCAGACCGTCGCCTTAAAGACAATATAGAAGA

TTATACAGGAAATGCGTTAAGTTTGATCGGCAAACTGAAAGTGAAAACTTACGATA

AAGTTAAATCTCTTAAAGACCGTGAAATTATCGGTCACGAGATCGGCATTATCGCAC

AGGATTTACAAGAAATATTACCGGAAGCTGTAAAATCTTCAAAAGTTGGCAATCTTG

ATAATCCAGACGATGTTCTGACAATTTCTAACTCTGCTGTGAATGCTCTTTTAATTAA

GGCTATTCAGGAAATGAGTGAAGAAATTAAAGAATTGAAAACTCCTTTCTTTACTAA

AATTGCTCGCAAAATTAGTAAATATTTTAAATTCTAA

WW202 GP38                                               (SEQ ID NO: 176)
ATGGCAGTAGTTGGTGTTCCTGGTTGGATTGGAAGTTCAGCCGCAAATGAAACAGG

GCAACGATGGATGAGTCAAGCGGCTGGTCAATTAAGATTGGGTGTTCCTTGCTGGAT

GAGCCAATTCTCCGGTCGTTCAAGAGAAATTATTCATACACTTGGAGCAGACCATAA

CTTCAATGGTCAGTGGTTCCGTGATAGATGCTTTGAAGCAGGTAGTACACCTATAGT

GTTTAATATCACCGGAGATTTAGTATCATATTCTAAAGATGTTCCTTTATTCTTTATG

TACGGAGATACACCTAATGAATATGTTCAGTTGAATATACATGGCGTAACGATGTAT

GGTCGTGGCGGGAATGGCGGTAGCAATAGTCCTGGATCAGCTGGGGGTCATTGTATT

CAAAATGATATTGTGGGAGACTAAGAATTAATAATGGTGGAGCTATTGCAGGTGG

CGGTGGCGGTGGCGGTGGCGGGTATTATTCTCCTTTTTCACAAATGAGATTAACCTT

TGGCGGTGGCGGTGGGCGTCCGTTTGGTGCACCCGGCGGATCTATTGATATGCAATC

AGGCGCAACTGCTGGTACTCTTTATGCTCCTGGATCGGGGTCCGTGAACGGTATCTA

TAATGGCGGAAGCGGTGGTGAGGTAGGCGCCGCAGGAGGTAGATGTAATATTCGTG

GTCAAGGATATGAATACAATGGCGGCGATGCTGGTTATGCTGTTATAGGTTCTTCTC

CAACGTGGCAAAATCGCGGAGCTATTTACGGACCTGCTGTTTAA

WW202 GP57A                                              (SEQ ID NO: 177)
ATGTCCAATCAGCATGAACAAATGATTAATGTCCTGAAAGTCCGTCTGTTTGACACT

CAAGAAAAAGCCGCATTCTTAGAAGGCCAACTGAAAGATCGTGAGCGTGTATTGAT

GGAACTGGTGCGTGTTCTGGGTATTCAGCCAGATGAAAATGGCACTGTTTCCCTTGA

TGCTATCGTCGAAGAAGTAAAAGCACTTCTCCCTAAAGACGAAGCAGCGGAAGACG

CTAAAGAGGAAGTAGAACTGATCACGGAGGCTTGA
```

Payloads p7.3 (p513)
(SEQ ID NO: 178)
CCTTTAGGGAAATATGCTAAGTTTTCACCGTAACACGCCACATCTTGACTATATATGTGTAG

AAACTGCCGGAAATCGTCGTGGTATTCTGACCAGAGCGATGAAAACGTTTCAGTTTGCTCAT

GGAAAACGGTGTAACAAGGGTGAACACTATCCCATATCACCAGCTCACCGTCTTTCATTGCC

ATACGAAACTCCGGATGTGCATTCATCAGGCGGGCAAGAATGTGAATAAAGGCCGGATAAA

ACTTGTGCTTATTTTTCTTTACGGTTTTTAAAAAGGCCGTAATATCCAGCTGAACGGTTTGGT

TATAGGTGCACTGAGCAACTGACTGGAATGCCTCAAAATGTTCTTTACGATGCCATTGACTT

ATATCAACTGTAGTATATCCAGTGATTTTTTTCTCCATTTTAGCTTCCTTAGCTTGCGAAATCT

CGATAACTCAAAAAATAGTAGTGATCTTATTTCATTATGGTGAAAGTTGTCTTACGTGCAAC

ATTTTCGCAAAAAGTTGGCGCTTTATCAACACTGTCCCTCCTGTTCAGCTACTGACGGTACTG

CGGAACTGACTAAAGTAGTGCGTAACGGCAAAAGCACCGCCGGACATCTGCGCTAGCGGAG

TGTATACTGGCTTACTATGTTGGCACTGATGAGGGTGTAAGTGAAGTGCTTCATGTGGCAGG

AGAAAAAAGGCTGCATCGGTGCGTCAGCAGAATATGTGATACAGGATATATTCCGCTTCCTC

GCTCACTGACTCGCTACGCTCGGTCGTTCGACTGTGGCGAGCGGAAATGGCTTACGAACGGG

GCGGAGATTTCCTGGAAGATGCCAGGAAGATACTTAACAGGGAAGTGAGAGGGTCGCGGCA

AAGCCGTTTTTCCATAGGCTCCGCCCCCCTGACAAGCATCACGAAATCTGACGCTCAAATCA

GTGGTGGCGAAACCTGACAGGACTATAAAGATACCAGGCGTTTCCCCCTGGCGGCTCCCTCG

TGCGCTCTCCTGTTCCTGCCTTTCGGTTTGCCGGTGTCATTCCTCTGTTACGGCCGAGTTTGTC

TCATTCCACGCCTGACACTCAGTTCCGGGTAGGCAGTTCGCTCCAAGCTGGACTGTATGCAC

GAACCCCCCGTTCAGTCCGACCGCTGCGCCTTATCCGGTAACTATCGTCTTGAGTCCAACCC

GGAAAGACATGCAAAAGCACCACTGGCAGCAGCCACTGGTAATTGATTTAGAGGAGTTAGT

CTTGAAGTCATGCGCCGGATAAGGCTAAACTGAAAGGACAAGTTTTGGCGACTGCGCTCCTC

CAAGCCAGTTACCTCGGTTCAAAGAGTTGGTAGCTCAGAGAACCTTCGAAAAACCGCCCTGC

AAGGCGGTTTTTTCGTTTTCAGAGCAAGAGATTACGCGCAGACCAAAACGATCTCAAGAAG

ATCATCTTATTAATCAGATAAAATATTTCTAGATTTCAGTGCAATTTATCTCTTCAAATGTAG

CACTTTATAGCTAGCTCAGCCCTTGGTACAATGCTAGCGTTTTCATTAAAGAGGAGAAAGGA

AGCCATGAGTAAAGGTGAGGAATTATTTACTGGTGTTGTTCCGATCTTAGTTGAACTGGACG

GCGATGTTAACGGTCATAAAATTCAGTGTTCGTGGTGAAGGTGAAGGTGATGCAACCAACGGT

AAGCTGACCCTGAAATTCATCTGCACTACTGGAAAATTACCAGTACCGTGGCCTACTCTGGT

GACTACCCTGACCTATGGTGTTCAGTGTTTTTCTCGTTACCCTGACCACATGAAGCAACATGA

TTTCTTCAAATCTGCAATGCCGGAAGGTTATGTACAGGAGCGCACCATTTCTTTCAAAGACG

ATGGCACGTATAAAACCCGTGCAGAGGTTAAATTTGAAGGTGACACTCTGGTGAATCGTATT

GAACTGAAAGGCATTGATTTCAAAGAGGACGGCAATATTTTAGGCCACAAACTGGAATATA

ACTTCAACTCCCATAACGTTTACATCACCGCAGACAAACAAAAGAACGGTATCAAAGCTAA

CTTCAAAATTCGCCATAACGTTGAAGACGGTAGCGTACAGCTGGCGGATCATTACCAACAGA

ACACTCCGATTGGAGATGCTCCTGTTTTACTGCCGGATAACCACTACCTGTCCACCCAGTCTA

AACTGTCGAAGGATCCGAACGAAAAGCGCGACCACATGGTGTTATTAGAGTTCGTTACCGCT

AGTGGTATCACGCACGGTATGGATGAACTCTACAAATAAGTCAGTTTCACCTGTTTTACGTT

AAAACCCGCTTCGGCGGGTTTTTACTTTTGGGTTTAGCCGAACGCCCCAAAAAGCCTCGCTTT

CAGCACCTGTCGTTTCCTTTCTTTTCAGAGGGTATTTTAAATAAAAACATTAAGTTATGACGA

-continued

```
AGAAGAACGGAAACGCCTTAAACCGGAAAATTTTCATAAATAGCGAAAACCCGCGAGGTCG

CCGCCCCGTAACCTGTCGGATCACCGGAAAGAACCTGTAAAGTGATAATGATTATCATCTAC

ATATCACAACGTGCGTAAAGGGACTATAACAAGACGCAAACGGAGGTAGGCTCACTCCTAC

TTCGGAAACTTAACCGAAGAACTAGGACGGTATTGTTTGCGCTTGGAATTGGCCTTGAAGTA

AGTCAGGTTTTGACGGAACGATTAGTTACAGGGGGGGAACAGTCGTTGGTCGCCACCAAGT

CGATTTTTGGCTTACCTCTTATCTCGTAGTTGGTGAGGGTTGGGATTCACGGGACGAGATCCA

GCCTAAGTATATTGTCACTTCTGATTCGTTCGATCACTTACTCCCCTTACTTATCCTGCGGCTA

CTGTTTCCGCTGGCTCGTAAGCTCTACGTTCGGCAATCTACCCGCGAGGTCAGACGTGACAC

TCTTAAACTAAAAATTGGTAGCTTCTTTGGCTGAATTGCTGGATCTTATTCGTTCACCCAATA

AAACGGTACAGCTTCAAGCAATATCCTCAGTAAGTTAATACCCGTTGTACTATTACTTTCAC

GACCGTTCGACGTTCCCGCTCTATTTATTAAGAGCTGTCACTTCGAGTCTTTAGCTCACTTAG

GAATTAGCTGAGTTTAGGCTCAGCCCTCTTGGGTTGCTTGTACTTTCAGAGTTATTCGCACGG

CTGGTTTTGTCGAGTGGGGAATTGTGGTTGACCGAAAGTCCGCTATCCTTCAACGCCGAATC

AGCTCTTGCCCTTTACTATCTTCAATCTCTTGGAGGCTATTACGGGCGGGGGCAAGAGATTA

GAACTGCAAGACACCCGTTGATAATCGAGTCGCTCGATAGATTGTCGAGAGCCGGAGAGAT

TAGTACGTTATTCAAGGCAATACGTGCAGGGTTAATCTGGGCGCGTTGTAGTCTACGCTGGC

GTAAGTCCCCAATAACACGCTCGTCCGGCGAGTCACGATCCTCTAGGCGGTGTTCAACGCGT

ACGCCAGCTATTTGGGATACTTAGCTACGTTACACGTAAGAATATCTTAGCGGAGGATCGCC

CTGCTTCCGCTTGGACGGATAAACGGGAGAGTGGGCGCGTATAGCGCAGGCGGTGTGAAGG

CTTTTAAGTAATTCTAGCCCTCTTTGAACGGTATTTCCCAATTTGGAGATTACCGGATAGCGC

GTTTAAATGAGTGTCAGAGAAACGGAAGCCGAAGTCTTTCCATTCCGGATGTTTGGAAATGC

TCTGTTTATAGAAGTCGATGAACTTACGGCAGTCCTCTATATTAAATTCGAATTTTTCATACC

CTTTCTGCGGGCTACCGTTTTTAGTGTGCGTGCTATGATTGCGGATGCGCAGAATATCCTCAG

ACGGGTTGTAGAATTTGATGCTTTTCGCGGAAAAGAACACTTTCGGTAACATTTTATTCGCA

CCCGGCAGGAGCTTGTACACGATTTTCTTATAGCCTTCACCCTTGTTTTCTTTGATCGCTTTAT

CGTCGAAGATCTTGTTGTTCTTCTTGTTCATTACGCCCAGATAGTATTTGTCGTCTTTGATGA

ACAGGATTGCGGTGTTGTCCGGCTCTTTGTTCTTATCCCAGCCGTTCGCCAGCGTGCTGTTTT

CGAAGTTCAGTTTGAATTTCTCGTCAGAGTAAGGCTTCTGCGTGATGTAGTTGCGGATTTTAT

TGTAGAGAGGGACGATGTTTGCCAGTTCGAAGTAACATTCTTCGAACACCAGATAGAAGTGT

TCATCTTTATCCAGAATGTTCGCCTTGTCCTCGCTCTGGCTGATGTGGAAGATTTTGAGCTTG

TGTAATAAGTTATTCGTCTGATCTAATAAGTCTTTAATTGCTTTCACATCGTCCTCCGCAGAT

GCTTGAAGCAGATCTTTCTTACCCTGATTCTGGTACTTGATAGAGATCTGCGCCAGATTGTCT

TTGTTTTGAGCAATTTCGTCGAAGATCATCGGGATTGCCGCAAAGTTCGCCAGAATTTCCTCA

AAACGACACTGTTTATCAATATCACGATGTTTATTAAATTCCTCAAGTGCCAGTTTGATAGTT

TCTAAGCTCAGGTATTTAGCTTTTTCTGTTTTCTTTGCAATCAGTTCCTGTTCCTTCTTGGACG

GGTTGTCCAGATTTTTCGGCGCGATTTGTTGGGTGATGTATTCCAAAACTGCCGTGCCGATCA

CGCTATAGTCATCGAAAACTTGTTGACTGAGATCGGTCAGAGATTTGTCGTTTTTAAAGTAA

ATCTTAGACAGATCTAGTTTCTGCGCTTTGAGGTCGTCAAAGAGCAGGGACAGAGTTTCTTT

AATAGATTTCTCTTCCACGGTTTTGAACGCCGCAATCTGCTCATAAAAGCTCTGCATCGTGGT

GACAACGTCGCTATCATCTTCCAGTTTATCAATTACGAAGGATTTAGATTCGGTGTCCGATA
```

```
-continued
AAATCTGTTTAAACAGAACGGACATTTTATACTTTTTCAGGGTTTTGTCGTTGATTTGTTGGC

TATACAGGTTAATGTATTCGTTGATGCCCTTACGCTTGGTGTTTTCGCCGTTAACAAATTTGC

CACCAATAATGGTGTTGAATTTGGTGATGCCAGATTGATTCAGGTAATTGTTGAAATTAGCG

ATTTCGAAAACCTCGTCCAGTGAGAAAACACGCTGGTTAACTTCGGAGGTTTTATAGTCGAT

GTCGAAGGTCAGTTCTTCCGCCAGATCTTTCTTGATCTGTTCATAGTTAATAGCTTCCGGTGC

TTTGTCTTTCAGAGATTCATATTTCGCTTTGTTTTCCAGAAACTTCGGCAGGTTGTCGTCCAC

GATACGATAAATAATAGAGGTCGGAATATCGTTGCTCGAATATACATTCTTACGGTTTTCAT

GAAAACCTTTGAAATACGTCGTCCAGCCTTTGAAAGACTTGATGATTTCGGTATTCGAATAT

GACCTGATCAAAGATAAACGTTTCACCGAAGATAAGTTCTTTTTCCACTGTCCGATTACCATC

AACTTCAAATCTAGCGGTGCGAACAAGTTCAACGATGAAATTAACTTATTACTGAAAGAGA

AAGCTAATGACGTACACATCTTATCTATTGATCGCGGTGAACGTCATTTAGCATACTATACA

CTGGTAGATGGTAAAGGTAATATTATTAAACAGGATACTTTCAATATTATCGGTAATGACCG

TATGAAAACCAACTATCACGATAAGCTGGCGGCGATCGAAAAGATCGTGATTCTGCGCGT

AAAGATTGGAAGAAAATTAACAATATCAAAGAAATGAAAGAAGGCTATCTGAGCCAAGTGG

TGCACGAGATCGCAAAACTGGTGATTGAATATAACGCTATCGTGGTTTTCGAAGATCTGAAC

TTTGGTTTTAAACGTGGTCGCTTCAAAGTAGAAAAACAGGTGTACCAAAAACTGGAAAAAA

TGCTGATTGAAAAACTGAACTATCTGGTTTTTAAAGACAACGAATTTGACAAAACGGGTGGC

GTACTCCGTGCCTATCAGCTGACCGCTCCGTTCGAAACGTTCAAGAAAATGGGTAAACAAAC

GGGGATTATCTATTATGTGCCAGCTGGTTTCACCTCCAAGATTTGTCCAGTTACGGGCTTCGT

TAACCAGCTGTACCCGAAATACGAGAGCGTTAGCAAATCTCAAGAATTTTTCAGCAAATTCG

ACAAGATCTGCTATAATCTGGATAAAGGCTATTTCGAGTTCAGCTTCGATTACAAAAACTTC

GGCGATAAAGCGGCTAAAGGTAAGTGGACTATTGCTAGCTTTGGTAGCCGTCTGATTAACTT

TCGCAACTCCGACAAAAACCATAATTGGGACACGCGTGAAGTGTATCCGACCAAAGAACTG

GAAAAATTACTGAAAGACTATTCCGGACACTCAGAAGGGTTATAGGAATAGTCACTACTGG

GGTAAGCACTTCGGAAATTATATTATTCTCGCTTCTTATTGCGGTAACGTGATCCTGAACGAT

ACTTATTACTTTGTAATTTACTTAACGTCGGAGTCCCTGCAATCTTCTAGTACCCGCTTCCCG

AATACAGGAGATAACTTTTTAACACTCAAGAGTTGCTTCGTGCTTAGCCAGTCTTGGATTTG

ATTGCTCTAATCCTTCAACGTGTCAAAGACAGTGTATCTGGTCAAGTAAAGTCTAGAGAAAG

GCGTAGTCAGTTACGGAGTTATCCCACCTTAGTGTTACTCCGATTTAATTTCTGCTTTCTTTG

ATTTCTACCCGACTTTCGCCGTGACTTCAATAGAGAGGCAGGCTCTTGCTATTTCTTTCAAGG

GCTTGTCCAACTACCTAATTAAGATAAAGATACGGCAGTTGACGCACTGCCGATAATTTCTT

TACGTCAGCGAAATTAAATCGAGCACCAGTCGTAGAGTCGCGGTTGCCTAGCAGTTTATCTC

GCGTACGGGCCTTCGCTACTTACACGATACCTAGTACGTGGATTCGGGTAGCACCAGAAGTC

TATAGCATGTGCATACCTTTGGTCGAAAAAAAAAGCCCGCACTGTCAGGTGCGGGCTTTTTT

CAGTGTTTCCTTGCCGGATTACGCCCCGCCCTGCCACTCATCGCAGTATTGTTGTAATTCATT

AAGCATTCTGCCGACATGGAAGCCATCACAAACGGCATGATGAACTTGGATCGCCAGTGGC

ATTAACACCTTGTCGCCTTGCGTATAATATTTTCCCATAGTGAAAACGGGGGCGAAGAAGTT

GTCCATATTTGCTACGTTTAAATCAAAACTGGTGAAACTCACCCAGGGATTGGCACTGACGA

AAAACATATTTTCGATAAAC
``` gpJ VARIANT

1A2
(SEQ ID NO: 179)

ATGGGTAAAGGAAGCAGTAAGGGGCATACCCCGCGCGAAGCGAAGGACAACCTGAAGTCC
ACGCAGTTGCTGAGTGTGATCGATGCCATCAGCGAAGGGCCGATTGAAGGTCCGGTGGATG
GCTTAAAAAGCGTGCTGCTGAACAGTACGCCGGTGCTGGACACTGAGGGGAATACCAACAT
ATCCGGTGTCACGGTGGTGTTCCGGGCTGGTGAGCAGGAGCAGACTCCGCCGGAGGGATTT
GAATCCTCCGGCTCCGAGACGGTGCTGGGTACGGAAGTGAAATATGACACGCCGATCACCC
GCACCATTACGTCTGCAAACATCGACCGTCTGCGCTTTACCTTCGGTGTACAGGCACTGGTG
GAAACCACCTCAAAGGGTGACAGGAATCCGTCGGAAGTCCGCCTGCTGGTTCAGATACAAC
GTAACGGTGGCTGGGTGACGGAAAAAGACATCACCATTAAGGGCAAAACCACCTCGCAGTA
TCTGGCCTCGGTGGTGATGGGTAACCTGCCGCCGCGCCCGTTTAATATCCGGATGCGCAGGA
TGACGCCGGACAGCACCACAGACCAGCTGCAGAACAAAACGCTCTGGTCGTCATACACTGA
AATCATCGATGTGAAACAGTGCTACCCGAACACGGCACTGGTCGGCGTGCAGGTGGACTCG
GAGCAGTTCGGCAGCCAGCAGGTGAGCCGTAATTATCATCTGCGCGGGCGTATTCTGCAGGT
GCCGTCGAACTATAACCCGCAGACGCGGCAATACAGCGGTATCTGGGACGGAACGTTTAAA
CCGGCATACAGCAACAACATGGCCTGGTGTCTGTGGGATATGCTGACCCATCCGCGCTACGG
CATGGGGAAACGTCTTGGTGCGGCGGATGTGGATAAATGGGCGCTGTATGTCATCGGCCAGT
ACTGCGACCAGTCAGTGCCGGACGGCTTTGGCGGCACGGAGCCGCGCATCACCTGTAATGC
GTACCTGACCACACAGCGTAAGGCGTGGGATGTGCTCAGCGATTTCTGCTCGGCGATGCGCT
GTATGCCGGTATGGAACGGGCAGACGCTGACGTTCGTGCAGGACCGACCGTCGGATAAGAC
GTGGACCTATAACCGCAGTAATGTGGTGATGCCGGATGATGGCGCGCCGTTCCGCTACAGCT
TCAGCGCCCTGAAGGACCGCCATAATGCCGTTGAGGTGAACTGGATTGACCCGAACAACGG
CTGGGAGACGGCGACAGAGCTTGTTGAAGATACGCAGGCCATTGCCCGTTACGGTCGTAAT
GTTACGAAGATGGATGCCTTTGGCTGTACCAGCCGGGGGCAGGCACACCGCGCCGGGCTGT
GGCTGATTAAAACAGAACTGCTGGAAACGCAGACCGTGGATTTCAGCGTCGGCGCAGAAGG
GCTTCGCCATGTACCGGGCGATGTTATTGAAATCTGCGATGATGACTATGCCGGTATCAGCA
CCGGTGGTCGTGTGCTGGCGGTGAACAGCCAGACCCGGACGCTGACGCTCGACCGTGAAAT
CACGCTGCCATCCTCCGGTACCGCGCTGATAAGCCTGGTTGACGGAAGTGGCAATCCGGTCA
GCGTGGAGGTTCAGTCCGTCACCGACGGCGTGAAGGTAAAAGTGAGCCGTGTTCCTGACGG
TGTTGCTGAATACAGCGTATGGGAGCTGAAGCTGCCGACGCTGCGCCAGCGACTGTTCCGCT
GCGTGAGTATCCGTGAGAACGACGACGGCACGTATGCCATCACCGCCGTGCAGCATGTGCC
GGAAAAAGAGGCCATCGTGGATAACGGGGCGCACTTTGACGGCGAACAGAGTGGCACGGTG
AATGGTGTCACGCCGCCAGCGGTGCAGCACCTGACCGCAGAAGTCACTGCAGACAGCGGGG
AATATCAGGTGCTGGCGCGATGGGACACACCGAAGGTGGTGAAGGGCGTGAGTTTCCTGCT
CCGTCTGACCGTAACAGCGGACGACGGCAGTGAGCGGCTGGTCAGCACGGCCCGGACGACG
GAAACCACATACCGCTTCACGCAACTGGCGCTGGGGAACTACAGGCTGACAGTCCGGGCGG
TAAATGCGTGGGGGCAGCAGGGCGATCCGGCGTCGGTATCGTTCCGGATTGCCGCACCGGC
AGCACCGTCGAGGATTGAGCTGACGCCGGGCTATTTTCAGATAACCGCCACGCCGCATCTTG
CCGTTTATGACCCGACGGTACAGTTTGAGTTCTGGTTCTCGGAAAAGCAGATTGCGGATATC
AGACAGGTTGAAACCAGCACGCGTTATCTTGGTACGGCGCTGTACTGGATAGCCGCCAGTAT
CAATATCAAACCGGGCCATGATTATTACTTTTATATCCGCAGTGTGAACACCGTTGGCAAAT

-continued

```
CGGCATTCGTGGAGGCCGTCGGTCGGGCGAGCGATGATGCGGAAGGTTACCTGGATTTTTTC

AAAGGCAAGATAACCGAATCCCATCTCGGCAAGGAGCTGCTGGAAAAAGTCGAGCTGACGG

AGGATAACGCCAGCAGACTGGAGGAGTTTTCGAAAGAGTGGAAGGATGCCAGTGATAAGTG

GAATGCCATGTGGGCTGTCAAAATTGAGCAGACCAAAGACGGCAAACATTATGTCGCGGGT

ATTGGCCTCAGCATGGAGGACACGGAGGAAGGCAAACTGAGCCAGTTTCTGGTTGCCGCCA

ATCGTATCGCATTTATTGACCCGGCAAACGGGAATGAAACGCCGATGTTTGTGGCGCAGGGC

AACCAGATATTCATGAACGACGTGTTCCTGAAGCGCCTGACGGCCCCCACCATTACCAGCGG

CGGCAATCCTCCGGCCTTTTCCCTGACACCGGACGGAAAGCTGACCGCTAAAAATGCGGATA

TCAGCGGTAACGTGAATGCGAACTCCGGGACGCTCAACAACGTCACGATTAACGAGAACTG

TCGGGTTCTGGGAAAATTGTCCGCGAACCAGATTGAAGGCGATCTCGTTAAAACAGTGGGC

AAAGCTTTCCCCCGGGACTCCCGTGCACCGGAGCGGTGGCCATCAGGAACCATTACCGTCAG

GGTTTATGACGATCAGCCGTTTGACCGGCAGATTGTTATTCCGGCGGTGGCATTCAGCGGCG

CTAAACATGAGAAGAGCATACTGATATTTACTCCTCATGCCGTCTGATAGTGCGGAAAAAC

GGTGCTGAAATTTATAACCGTACCGCGCTGGATAATACGCTGATTTACAGTGGCGTTATTGA

TATGCCTGCCGGTCACGGTCACATGACACTGGAGTTTTCGGTGTCAGCATGGCTGGTAAATA

ACTGGTATCCCACAGCAAGTATCAGCGATTTGCTGGTTGTGGTGATGAAGAAAGCCACTGCA

GGCATCACGATTAGCTGA
```

STFs
>WT STF (SEQ ID NO: 180)
```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGGTGGT

AATGGATGAGACTAATCGTAAGGCACCTCTGGACAGTCCGGCACTGACCGGAACGCCAACA

GCACCAACCGCGCTCAGGGGAACAAACAATACCCAGATTGCGAACACCGCTTTTGTACTGG

CCGCGATTGCAGATGTTATCGACGCGTCACCTGACGCACTGAATACGCTGAATGAACTGGCC
```

-continued

```
GCAGCGCTCGGGAATGATCCAGATTTTGCTACCACCATGACTAACGCGCTTGCGGGTAAACA

ACCGAAGAATGCGACACTGACGGCGCTGGCAGGGCTTTCCACGGCGAAAAATAAATTACCG

TATTTTGCGGAAAATGATGCCGCCAGCCTGACTGAACTGACTCAGGTTGGCAGGGATATTCT

GGCAAAAAATTCCGTTGCAGATGTTCTTGAATACCTTGGGGCCGGTGAGAATTCGGCCTTTC

CGGCAGGTGCGCCGATCCCGTGGCCATCAGATATCGTTCCGTCTGGCTACGTCCTGATGCAG

GGGCAGGCGTTTGACAAATCAGCCTACCCAAAACTTGCTGTCGCGTATCCATCGGGTGTGCT

TCCTGATATGCGAGGCTGGACAATCAAGGGGAAACCCGCCAGCGGTCGTGCTGTATTGTCTC

AGGAACAGGATGGAATTAAGTCGCACACCCACAGTGCCAGTGCATCCGGTACGGATTTGGG

GACGAAAACCACATCGTCGTTTGATTACGGGACGAAAACAACAGGCAGTTTCGATTACGGC

ACCAAATCGACGAATAACACGGGGGCTCATGCTCACAGTCTGAGCGGTTCAACAGGGGCCG

CGGGTGCTCATGCCCACACAAGTGGTTTAAGGATGAACAGTTCTGGCTGGAGTCAGTATGGA

ACAGCAACCATTACAGGAAGTTTATCCACAGTTAAAGGAACCAGCACACAGGGTATTGCTT

ATTTATCGAAAACGGACAGTCAGGGCAGCCACAGTCACTCATTGTCCGGTACAGCCGTGAGT

GCCGGTGCACATGCGCATACAGTTGGTATTGGTGCGCACCAGCATCCGGTTGTTATCGGTGC

TCATGCCCATTCTTTCAGTATTGGTTCACACGGACACACCATCACCGTTAACGCTGCGGGTA

ACGCGGAAAACACCGTCAAAAACATTGCATTTAACTATATTGTGAGGCTTGCATAA

>WT STF accessory protein 1
                                                 (SEQ ID NO: 181)
ATGGCATTCAGAATGAGTGAACAACCACGGACCATAAAAATTTATAATCTGCTGGCCGGAA

CTAATGAATTTATTGGTGAAGGTGACGCATATATTCCGCCTCATACCGGTCTGCCTGCAAAC

AGTACCGATATTGCACCGCCAGATATTCCGGCTGGCTTTGTGGCTGTTTTCAACAGTGATGA

GGCATCGTGGCATCTCGTTGAAGACCATCGGGGTAAAACCGTCTATGACGTGGCTTCCGGCG

ACGCGTTATTTATTTCTGAACTCGGTCCGTTACCGGAAAATTTTACCTGGTTATCGCCGGGAG

GGGAATATCAGAAGTGGAACGGCACAGCCTGGGTGAAGGATACGGAAGCAGAAAACTGT

TCCGGATCCGGGAGGCGGAAGAAACAAAAAAAAGCCTGATGCAGGTAGCCAGTGAGCATAT

TGCGCCGCTTCAGGATGCTGCAGATCTGGAAATTGCAACGAAGGAAGAAACCTCGTTGCTG

GAAGCCTGGAAGAAGTATCGGGTGTTGCTGAACCGTGTTGATACATCAACTGCACCTGATAT

TGAGTGGCCTGCTGTCCCTGTTATGGAGTAA

>SIED6
                                                 (SEQ ID NO: 182)
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA
```

-continued

```
GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTGATCCTGCTTCTGTCCCTCCGCTTCCTGATATCTGGCTACCCTTGAATGATTCTCTG

GAAGCGATAACAGGGTATGCGCCGGGGTATAAAACAATAACCATCGGCAGCGATGAAATCA

CTGTGCCAGTTAATGGCATATGCCAATTTAGCCGGGCTTCATCTGCAACGTATATTGATAAG

TCCGGGCATATTACCGTGGCAGGGAATAACGTTCCTCGTTTTGAAAAATATGGTTTGCTGAT

AGAGAATCAGCGAACAAACATGTTCGTAAATAGTTTTAATCCTGATGCGTGGAATAAAAGC

GGTGGTATATCTGTAACATCATCAACAGATGAATTTGAGTTTAAATATGGACGTTTCACAGT

AGGAAGCGACATAGCAGGAACGACAACAGGGAGAAATATATGCACAGTTGCTGGTAATAG

AGGCATAGATGTGACTGGCGATGATCAGTACAGTAAAGGTCCGTATGTTACCGCGTCGTTCA

GGGTAAGAAGTGATCTCAATGTTCGCGCACGTATCCGTTTTGAACGGTATAACTCGGAAGGA

TACACTTTCCTTTGTGACGCCTATTTGTCATTACAGACCCATGAACTACAAATTACGGGTGAT

AATGCCCAGCTATTAACAGCAAACTTTGAAATCGATCCAGGTAGTGGATGGATATATTTTCA

GGCAACCCTGAAATGTCTGCCAGAATGGGGAATGGTTGGTACGCAGTTGCAAATTGCAGCC

GACAGAGCTGTGGGTCTTTTGCAACAGGTGACTGGATAGAAGTAACCACCCCGCAATTTGA

GTATGGTGCTTGTGCAACTTCCTTTATCATAACGACAACAGAGCCAGCGACTCGTGCATCAG

ATTTATGTAAATTTCCGCTGATGAAAAATATGTATACCATGCCTTTTACGTTCATGGTGGAAG

TCCATAAAAACTGGTTTATTGCTCATAATGCTGCACCGCGAGTAATTGATACAGAAAACCAT

CAGTCAGGTGCTCCATTTATCATGGGATTTGGCTCTTCTGGAACTATCAGTCAGGACGGTTAT

CCCTATTGTGATATAGGCGGGGCTAACCGACGTGTATATGAGTCATGCGGAGTAAGAGATCT

TGTTATGGGATTCAGGGTTAAGGCTGACGGCATGACATGCTCATTTGCAAATAAGCATATAA

GCACAGAAACAAAAACAGTATGGAAATATATTCGTGAAGCTGCTGTGATTCGTATCGGGGG

ACAAACGACGACAGGATTACGACACCTTAATGGTCATATAAAAAACCTCCGTTTCTGGAACA

GAGCATTGTCAGATACGCAGCTTAAGGAATACGTATAA
```

>SIED6 accessory protein 1
(SEQ ID NO: 183)
```
ATGCGGGATATAACATTACGATTCGATAACAGAGAACAGTTTAACGCAATTGTATATGACAG

TGGCCTGTTCAGTCTTGAAGAAGAAAACGGGATTCTTGTTGATGTTATTGGCCGCGTTATCG

ATTACGAGGAGCCAGAAAACGAAAGATGTACAGGCATTGATCGCGGCGGTTTTTTCGTAAA

CATGAGGATTGTTGATAGCAGTAAAAACATATCTTCTTTAATGCCTTTCATTACGACAGATC

AGCATGTAAGGACATGGGCTTAA
```

>SIED6 accessory protein 2
(SEQ ID NO: 184)
```
ATGGTTACAAAAACAGTAATTCCTGATGACATCAAAACGCTAAAATCCGATGTTAGTAAACT

AAAAAACGATCAAGGAAGCTACGCAACAAAATCATATGTAGACAGCAAAGATGAAACCGTT

GGTGACTGGTCTGCTTCATGGTATCAGCAGGTATTGCCAACTAGCGGAGCTATATTTGGGAG

AAAACTCCGCTCAACTCACCGGACGGCAGGTGTTGAGGATGCGTATTGCGAACTATACCTTA

AAAAATGGATAGACAGCCCAGGGAACGCAATGGCGCGCCTTAACCTGAACGATAACGGTGA

AAATATTTGCTGGGATTTTACCAACCTTTACGGCGGAACAATGATCTTCCCTGGAACTTCAG

GCTATCTGAAAATGGGGAACTGTCTCATGTCGTATGGTGTGCGGGGAAGTAACGCGCTTATT
```

-continued

```
AAGTTTGATAATACAGACTCATTGCAGATCAAATATGCTAATCACGGGTCGACCATGACACT

AAACACGCAAGGCACGGCGTATTCTGGTGTGTCGACGTTATTATGGGGAAATTCCAGTCGTC

CAGTTGTTTATGAGATTAGGGATGATGGCGGGCTTTTTTGTTTTATGCACAAAGGAACCCA

GATAAAACCTATCAGCTTGAGATAAACGGGCCATGTAAGGCTACATCATTCGACCAGGTGTC

GGACAGAGATCTTAAAGAAAACATTCGGGTTATTGATAATGCCACTGAACGCATCAGATTA

ATGAATGGGTATACTTACCGTCTCAAGTCTAATGGTATGCCTTATGCTGGCGTTATTGCGCAA

GAGGCACTTAATGCAATCCCTGAATCAGTTGGTAGCACAATAAAGTACAAGAGCGGGGACA

ATGGGTCTGATGGAGAATAG
```

SIEA11

(SEQ ID NO: 185)

```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGGCAGC

AAATGACAACGCAAATTCACGTCTGGCGAAAAATCAGAATGGTGCAGATATCCAGGATAAA

TCAGCTTTTCTGGACAATGTTGGCGTTACCAGCCTGACGTTTATGAAAAACAATGGCGAAAT

GCCGGTTGATGCTGATCTGAATACGTTTGGTTCTGTTAAGGCTTATTCAGGTATCTGGTCTAA

AGCAACGTCCACCAACGCAACACTGGAGAAAAACTTCCCTGAAGATAATGCTGTCGGTGTG

CTTGAGGTTTTTACTGGCGGCAATTTTGCAGGCACGCAACGCTATACCACACGTGACGGAAA

TTTGTATATCCGCAAACTCATTGGAACATGGAATGGTAATGATGGACCATGGGGAGCATGGC

GCCATGTTCAGGCTGTAACGCGAGCTCTAAGTACGACCATTGACCTTAACTCTCTCGGTGGC

GCAGAACATTTAGGTCTATGGAGAAACAGCAGTTCAGCAATAGCTTCTTTTGAACGACATTA

CCCCGAGCAGGGAGGAGACGCGCAGGGCATTCTGGAAATTTTCGAAGGTGGGCTATATGGA

CGCACACAGCGTTATACAACCCGTAACGGGACTATGTATATTCGCGGCCTGACAGCCAAATG

GGATGCAGAAAATCCACAGTGGGAAGACTGGAACCAAATTGGTTATCAGACCAGTAGTACC

TTCTATGAGGATGACCTGGATGATTTGATGTCTCCAGGTATTTACAGTGTGACAGGCAAAGC
```

-continued
```
GACCCACACCCCAATCCAGGGGCAGTCTGGTTTTCTGGAAGTCATCAGGCGCAAGGATGGTG

TCTATGTTTTGCAACGTTACACGACCACAGGAACCAGCGCAGCTACAAAAGACCGTTTATAT

GAGCGAGTGTTTCTTGGTGGCTCATTTAACGCGTGGGGGAGTGGCGACAGATTTATAACTC

AAACTCTTTGCCGTTAGAGTTGGGTATCGGTGGCGCAGTGGCAAAACTCACCAGCCTGGACT

GGCAGACATACGATTTTGTGCCGGGCAGTCTGATAACCGTTCGGCTGGATAACATGACCAAT

ATTCCCGACGGTATGGACTGGGGCGTCATTGATGGCAACCTGATAAACATCTCAGTCGGTCC

GAGTGATGATTCTGGTTCGGGACGCTCAATGCATGTATGGCGCAGCACTGTAAGTAAAGCCA

ACTACCGCTTTTTTATGGTGCGTATTTCAGGAAATCCGGGAAGCCGCACGATCACGACAAGA

CGTGTGCCAATTATCGACGAAGCCCAGACATGGGGCGCGAAACAGACATTCAGTGCTGGCC

TTTCTGGTGAACTGTCCGGCAATGCGGCGACAGCAACAAAGCTGAAAACAGCCCGTAAAAT

TAATAACGTTTCGTTTGATGGAACATCAGATATTAACCTGACGCCGAAAAATATTGGTGCAT

TTGCTTCAGGAAAAACAGGAGACACCGTTGCGAATGATAAAGCCGTTGGATGGAACTGGAG

TAGCGGAGCCTATAACGCAACTATTGGTGGGGCATCAACGTTAATTCTTCATTTTAATATCG

GGGAAGGAAGTTGTCCCGCCGCCCAGTTTCGCGTTAATTATAAGAACGGTGGTATTTTTTAT

CGTTCTGCTCGTGACGGTTACGGATTCGAGGCTGACTGGTCTGAGTTTTATACCACAACGCG

AAAACCTACAGCGGGAGATGTCGGTGCACTGCCGTTATCTGGTGGTCAATTGAATGGTGCTC

TGGGTATAGGAACATCCAGTGCTCTTGGCGGTAATTCGATTGTTTTGGGTGATAATGACACG

GGCTTTAAACAAAATGGTGATGGTAATCTGGATGTTTATGCTAATAGCGTCCATGTTATGCG

CTTTGTCTCCGGAAGCGTTCAAAGTAATAAAACCATAAATATTACGGGGCGTGTTAATCCCT

CGGATTACGGTAACTTTGATTCCCGCTATGTGAGAGATGTCAGACTTGGCACACGTGTTGTC

CAGACCATGCAGAAAGGGGTGATGTATGAGAAAGCAGGGCACGTAATTACCGGGCTTGGTA

TTGTCGGTGAAGTCGATGGTGATGACCCCGCAGTATTCAGACCAATACAAAAATACATCAAT

GGCACATGGTATAACGTCGCACAGGTGTAA
```
SIEA11 accessory protein 1

(SEQ ID NO: 186)
```
ATGCAGCATTTAAAAAATATTACTGCGGGTAATCCAAAAACTGTTGCCCAATATCAACTGAC

AAAAAATTTTGATGTTATCTGGTTATGGTCCGAAGAGGGAAAAAACTGGTATGAGGAAGTA

AGTAATTTTCAGGAAGACACGATAAAGATTGTTTACGATGAGAATAATATAATTGTCGGCAT

CACCAGAGATGCTTCAACGCTCAACCCTGAAGGTTTTAGCGTTGTCGAGGTTCCTGATATTA

CCGCCAACCGACGTGCTGATGACTCAGGTAAATGGATGTTTAAGGATGGTGCCGTGATTAAG

CGGATTTATACGGCAGACGAACAGCTGCAACTGGCGGAATTACAGAAGTCAGCTTTGCTTTC

CGAAGCTGAAACTATCATTCAGCCACTGGAACGCTCTGTCAGACTGAATATGGCAACAGATG

AGGAGCGTAGCCGACTGGAAGCATGGGAACGCTACAGTGTTCTGGTCAGCCGTGTGGATCC

TGCAAATCCTGAATGGCCGGAAATGCCGCAATAA
```
EB6

(SEQ ID NO: 187)
```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC
```

-continued

```
CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGATTGC

GATGGATAATGCCAATGCCCGTCTGGCAAAAGACCGGAACGGAGCAGATATTCCCAATAAG

CCGCTGTTTATCCAAAACCTCGGTTTACAGGAAACGGTAAACAAGGCTGGTAACGCCGTTCA

AAAGACAGGCGATACCTTGTCCGGCGGACTTACTTTTGAAAACGACTCAATCCTTGCCTGGA

TTCGGAATACTGACTGGGCAAAGATTGGATTTAAAAATGATGCCGACAGCGACACTGATTCA

TACATGTGGTTTGAAACAGGCGACAACGGCAATGAATATTTCAAATGGAGAAGCCGCCAGA

GCACCACAACAAAAGACCTGATGAATCTTAAATGGGATGCTTTGTATGTTCTTGTCAATGCC

ATTGTAAATGGCGAAGTCATATCAAAATCAGCAAACGGCCTACGTATTGCTTATGGTAATTA

CGGATTCTTTATTCGTAATGATGGTTCAAATACATACTTCATGTTGACAAACTCCGGTGACAA

CATGGGGACTTATAACGGATTAAGGCCATTATGGATTAATAACGCTACTGGCGCTGTTTCGA

TGGGGCGTGGTCTTAATGTTTCAGGGGAGACACTTTCAGACCGTTTTGCTATTAACAGCAGT

AATGGTATGTGGATTCAGATGCGCGATAACAACGCTATCTTTGGGAAAAATATAGTTAACAC

TGATAGCGCTCAGGCGTTACTTCGCCAGAATCACGCCGACCGAAAGTTCATGATAGGTGGAC

TGGGGAACAAGCAATTTGGCATCTACATGATTAATAACTCAAGGACAGCCAATGGCACCGA

TGGTCAGGCGTACATGGATAATAACGGTAACTGGCTTTGTGGTGCGCAAGTTATTCCCGGCA

ATTATGGCAATTTTGACTCACGCTATGTGAGAGATGTCCGACTTGGCACACGTGTTGTTCAAT

TGATGGCGCGTGGTGGTCGTTATGAAAAAGCCGGACACGCAATTACCGGATTAAGAATCATT

GGTGAAGTAGATGGCGATGATGAAGCCATCTTCAGGCCAATACAAAAATACATCAATGGCA

CATGGTATAACGTCGCACAGGTGTAA
```

EB6 accessory protein 1

(SEQ ID NO: 188)
```
ATGCAGCATTTAAAAAATATTAAGTCTGGAAATCCTAAAACGAAAGAACAATATCAGCTAA

CAAAGAATTTTGATGTTATCTGGTTATGGTCCGAAGACGGTAAAAACTGGTATGAAGAAGTA

AATAACTTTCAGGACGACACCATAAAGATTGTATACGACGAAAATAATATTATTGTTGCCAT

AACCAAAGATGCCTCAACGCTTAATCCCGAAGGCTTTAGCGTCGTTGAGATTCCAGATATAA

CAGCCAATCGTCGTGCCGATGATTCAGGGAAGTGGATGTTTAAGGACGGAGCTGTGGTTAA

ACGGATTTATACGGCAGACGAGCAACAACAACAGGCCGAATCACAAAAGGCCGCGTTACTT

TCCGAAGCAGAAAACGTTATTCAGCCACTGGAACGCGCTGTCAGACTGAATATGGCGACGG

ATGAGGAACGCGCACGACTGGAGTCATGGGAACGCTACAGTGTTCTGGTCAGCCGTGTGGA

TACGGCAAAGCCAGAATGGCCACAAAAGCCTGAATAA
```

-continued

AH11L (SEQ ID NO: 189)

ATGGCAGTAAAGATTTCAGGAGTCCTGAAAGACGGCACAGGAAAACCGGTACAGAACTGCA
CCATTCAGCTGAAAGCCAGACGTAACAGCACCACGGTGGTGGTGAACACGGTGGGCTCAGA
GAATCCGGATGAAGCCGGGCGTTACAGCATGGATGTGGAGTACGGTCAGTACAGTGTCATC
CTGCAGGTTGACGGTTTTCCACCATCGCACGCCGGGACCATCACCGTGTATGAAGATTCACA
ACCGGGGACGCTGAATGATTTTCTCTGTGCCATGACGGAGGATGATGCCCGGCCGGAGGTGC
TGCGTCGTCTTGAACTGATGGTGGAAGAGGTGGCGCGTAACGCGTCCGTGGTGGCACAGAG
TACGGCAGACGCGAAGAAATCAGCCGGCGATGCCAGTGCATCAGCTGCTCAGGTCGCGGCC
CTTGTGACTGATGCAACTGACTCAGCACGCGCCGCCAGCACGTCCGCCGGACAGGCTGCATC
GTCAGCTCAGGAAGCGTCCTCCGGCGCAGAAGCGGCATCAGCAAAGGCCACTGAAGCGGAA
AAAAGTGCCGCAGCCGCAGAGTCCTCAAAAAACGCGGCGGCCACCAGTGCCGGTGCGGCGA
AAACGTCAGAAACGAATGCTGCAGCGTCACAACAATCAGCCGCCACGTCTGCCTCCACCGC
GGCCACGAAAGCGTCAGAGGCCGCCACTTCAGCACGAGATGCGGTGGCCTCAAAAGAGGCA
GCAAAATCATCAGAAACGAACGCATCATCAAGTGCCGGTCGTGCAGCTTCCTCGGCAACGG
CGGCAGAAAATTCTGCCAGGGCGGCAAAAACGTCCGAGACGAATGCCAGGTCATCTGAAAC
AGCAGCGGAACGGAGCGCCTCTGCCGCGGCAGACGCAAAAACAGCGGCGGCGGGGAGTGC
GTCAACGGCATCCACGAAGGCGACAGAGGCTGCGGGAAGTGCGGTATCAGCATCGCAGAGC
AAAAGTGCGGCAGAAGCGGCGGCAATACGTGCAAAAAATTCGGCAAAACGTGCAGAAGAT
ATAGCTTCAGCTGTCGCGCTTGAGGATGCGGACACAACGAGAAAGGGGATAGTGCAGCTCA
GCAGTGCAACCAACAGCACGTCTGAAACGCTTGCTGCAACGCCAAAGGCGGTTAAGGCAGC
AAATGACAACGCAAATTCACGTCTGGCGAAAAATCAGAACGGTGCAGATATCCAGGATAAA
TCAGTTTTTCTGGACAATGTTGGCGTTACCAGCCTGACGTTTATGAAAAACAATGGCGAAAT
GCCGCTTGATGCTGATCTGAATACATTTGGTCCCGTTAAGGCTTATCTGGGGATCTGGTCTAA
AGCTACCTCAACTAACGCAACACTGGAGAAAAATTTCCCGGAAGATAATGCTGTCGGTGTGC
TTGAGGTTTTTGCTGCCGGCAATTTTGCAGGTACGCAACGCTTTACCACAAGAGACGGCAAT
GTATACATGCGTAAACTCGCCAATAAGTGGAATGGCACTGATGGTCCGTGGGGCGTATGGC
GTCACACTCAATCAGCTACCCGCCCTTTGAGTACGACTATAGACCTGAATACGCTTGGAGCC
GCCGAACATCTTGGTTTATGGCGTAACAGTAGCTCGGCTATAGCTTCATATGAACGCAATTA
TCCAGAGGAAGGCGGCTTTGCTCAGGGGACGCTTGAGATCCTCGAAGGCGGGAATTATGGA
AGAACGCAACGTTATACCACTCGCCGTGGAAATATGTATGTCCGCTGCCTTGCGGCAAGCTG
GGATGCATCAAATCCGCAGTGGGAACCGTGGTTAAGAGTCGGTCATCAGTCAGAGAGTCGT
TATTACGAAGGTGATTTGAATGATGTAACCTCACCAGGTATTTACAGCGTTACAGGTAAAGC
GACCAACGGTCCAGTACTGGACGGAAACGGCGTGACTGTACTCGGCATTCTGGAAGTGTTG
AGGCGGTTTGATGGTGTTAATGTATGGCAGCGTTATACAACTGCCGGAACAGGTACAACCCT
TAAAGGCCGCACCTTTGAGCGCGTCTTTACCGGCAGCTCATGGAGCGAATGGCGGGAAGTCT
ACACCTCGTATTCACTTCCCCTGAATCTGGGTATCGGCGGTGCTGTGGCAAAGCTCACCAGC
CTGGACTGGCAGACCTACGATTTTGTGCCGGGCAGTCTGATAACCGTTAGGCTGGATAATAT
GACCAATATTCCCGACGGTATGGACTGGGGCGTCATTGATGGCAACCTGATAAACATCGCAG
TTGGTCCGAGTGATGATTCCGGTACGGGGCGCTCAATGCATGTATGGCGCAGCACTGTAAGT
AAAGCGAACTACCGATTYTTTATGGTGCGTATTTCAGGAAATCCGGGAAGCCGCACGATCAC
AGCAAGACGAGTACCAATCATTGACGAAGCCCAGACATGGGGCGCGAAACAGACATTCAGT

-continued

```
GCTGGCCTTTCTGGTGAACTGTCCGGCAATGCGGCGACAGCAACAAAGCTGAAAACAGCCC

GTAAAATTAATAACGTTTCGTTTGATGGAACATCAGATATTAACCTGACGCCGAAAAATATT

GGTGCATTTGCTTCAGGAAAAACAGGAGACACCGTTGCGAATGATAAAGCCGTTGGGTGGA

ACTGGAGTAGCGGAGCCTATAACGCAACTACTGGTGGGGCATCAACGTTAATTCTTCATTTT

AATATCGGTGAAGGAAGTTGTCCCGCCGCCCAGTTCCGCGTTAATTATAAGAACGGCGGTAT

TTTTTATCGTTCTGCTCGTGACGGTTACGGATTCGAGGCTGACTGGTCTGAGTTTTATACCAC

AACGCGAAAACCTACAGCGGGAGATGTCGGTGCACTGCCGTTATCTGGTGGTCAATTGAATG

GTGCTCTGGGTATAGGAACATCCAGTGCTCTTGGCGGTAATTCGATTGTTTTGGGTGATAAT

GACACGGGCTTTAAACAAAATGGTGATGGTAATCTGGATGTTTATGCTAATAGCGTCCATAT

TATGCGCTTTGTCTCGGGAAGTATTCAAAGTAATAAAACCATAAATATTACGGGGCGTGTTA

ATCCCTCGGATTACGGTAACTTTGATTCCCGCTATGTCCGGGATATCCGGCTTGGTGGTGCTG

CCACATACAAACCTGCGAACAATGGCATGACATGGACACATCAGGCACCGTCCGGGTGTGT

ATATTCCGGCATTATTGTTCAGGATACCGGCTCAAACTCTGCCGATAACATTGGTGGTGTAT

ATTACAGGCCGGTTCAGAAATACATTAACGGGACATGGTATAACGTGGCGCAGGTATAA

AH11L accessory protein 1
                                                        (SEQ ID NO: 190)
ATGCAGCATTTGAAAAATATTACGGCGGGTAATCCAAAAACGGTTGAACAATATCAATTGA

CAAAGGGTTTTGATGTTGTCTGGTTTTTTTCAGAAGATGGTAAGAACTGGTACGAAGAACAA

AAGTATTTTGCTGATGACACGATAAAAATAGCGTACGACAAAGATAATATTATCCGCTATGT

GGAAAAGGATGTGACAGCTATCAGACCGGATGGATTAAGTGTTGTTGAAGTGGCGGATATT

ACTGCTAACCGACGGGCGGACATTTCAGGGGCTGGATGTTTAAGGACGGCAAAGTGATTA

AACGCATTTATACGGCAGAGGAATTGCTGCAGCAGGCAGAAAACCGGAAAGCCAGACTTCT

TGCAGATGCTGAATCCGTGATTTTGCCGCTGGAGCGCGCGGTCAGACTGAACATGGCAACAG

ATGAGGAGCGTAGCCGACTGGATGCATGGGAGCGTTACAGCGTTCTGGTCAGTCGTGTGGAT

CCTGCAAATCCTGAATGGCCGGAAATGCCGCAATAA

WW55 3.0 accessory protein 1
                                                        (SEQ ID NO: 191)
ATGGCAATATCTTCTGGATGGGTAGGATCATCTGCTGTGTCCGAGACTGGTCAACGGTGGAT

GAGCGCCGCAATGCAAGCTGTTCGCTTAGGTCGTCCGGCGTATATGTCGGCAATGGTCGGAC

GCTCTAAAGAGATTCATTATAGCATTGGTGCTAGTAACTCTTACAATAAAGACACTCTTATT

AACTGGATGAAAGCACAAGGATCTACTCCGGTAGTAATTACTATCACGGGTAATATTGTTTC

CCAATCTACTGGCGTTCCTTGTCTTGATTTCCCTAGCTCACTGACAAACGAATATGTAACACT

CATTATTAACTCTGGTGTTCATGTATTAGGTCGTGGAGGAAATGGCGGAAGTAACTCTGCTG

GTGGAGCAGGAGGAAATGCAATAAATAACGGAATTGGAACTCGTTTAAGAATAAACAATAA

TGGTATTATTGGTGGTGGCGGTGGTGGCGGTGCTGGTGCTAGATACAATCCTTTCCCTCAAA

TGGATATGAAATTTGGCGGCGGTGGAGGCCGTCCATTTGGTGCTGCGGGTGCGGCAGGAGG

CGGCGCAGCGGCAGCATCTGCTGGTACAATTTCTGCCCCAGGTAAAGGCACTGTTTCTGGGG

TTCATTATGGAGGAGATGGTGGAGATTTGGGAGCTGCTGGCAAATCTTCATATATTAAAGGT

GGTACTGGTGGAACTGTTCACTCGGGTGGTGCTGCGGGTAAAGCTGTTACTGGTAATGCCCC

TCGCTGGGATAAAGTAGGCACGATCTACGGTGCTCGCGTGTAA

WW55 3.0 accessory protein 2
                                                        (SEQ ID NO: 192)
ATGTCCAATCAGCATGAACAAATGATTAATGTCCTGAAAGTACGTCTGTTTGACACTCAAGA
```

-continued

AAAGGCCGCATTCTTAGAAGGCCAACTGAAAGATCGTGAGCGTGTATTGATGGAACTGGTA

CGCATTCTGGGTATTCAGCCAGACGAAAACGGCACTGTTTCCCTTGATGCTATTGTCGAAGA

AGTGAAAGCACTTCTCCCTAAAGACGAAGCAGCGGAAGACGCAGAAGAGGAAGTAGAACT

GATCACGGAGGCTTGA

STF68B (SEQ ID NO: 193)
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGCTTCTGCCACTGCATCTGCCAACAGTCAA

AAAGCTGCAAAGACGAGCGAAACCAACGCAAAGACAAGCGAGACTGCGGCGGCTAACTCG

GCGAAAGCATCAGCTGCAAGCCAGACGGCTGCAAAAGCGAGTGAAGACGCAGCCAGAGAG

TATGCAAGCCAGGCTGCGGAGCCGTATAAACAAGTTTTGCAGCCGCTTCCCGATGTGTGGAT

ACCGTTTAACGATTCACTGGAAATGATTACTGGTTTCGCTCCTGGTTATAAAAAAGTAACTA

TCGGTGATGATGTTATTACTTTTCCATCAGAGAAGGTTGTATCTTTCACTCGCTCCACTTCTG

CAACGTATATAAACAAATCAGGTTCATTTGCTTTTGCAGAAATTAACGAGCCGCGCTTTGAA

AAGGAAGGTTTATTAATTGAAGGTCAGAGGACAAATACATTTACTAATAGTAACAATCCTTC

ATTATGGAATTATGACGACAAGAATATAGAAATAACCACATCGGTTGATGAATATGGTTTTA

AATATGGTTTGTTCGATGTAAAGGAAACATCAACTACTGAAAGGGCGACGATAATATCTACT

GGATACAGTAGGGTTATTGATGTTGCTGCAAATGAATCTGTTACTTTGTCCTGTAGGGTTAA

GAAGATAAATGGAGAAGGTATTATAACGTTAAGACCCAGAATATCTTTCGTTAACGATGAC

GGTACAAGCAACACGCTGGTAGCTGGTTCCTACATAGATTGCGAAACTGGTGATGTTTTAGG

TTTTTCTGGTGGGATGCTGTAAATCATGTCATATACAGAGAAGCTAACGGATGGTTACGCG

TCGAATTTACATATAAATCACCAGAAGCAAAAAGCATGTATGGGCGCTTTGAAATGGGAGC

AGATAAAAGGGCGATCAAAAAGGCGATCAGATAATGTTTACTACGCCGCAATTTGAAAAA

GGATCGTGTGCATCATCATTTATCGTTACATCAGATGTGGCAGTTACACGGGCTAGTGACGT

GGTAATAATGCCAATAAGACTGAACTGGTCAACACCTCCGTTAAGCGTTCTTATGGAAGTTA

ATATCAACTGGGACAAAATGCCAAACAGTGAAGGTTCAGCAAGGCTTCTTAACGTGTCAAT

AACTGGCGCAACAACGGATGTTGCTGATGAAAGTTATATGTATTTTGGTTTTACCTCTGGAG

GCGCGCGCTCAATTATAACTAACGGAAAAGGAACAAAGACCGAGTATAAAGCCTACTGTAA

CAGGACAACCCGCAGGTTTATTGCTGGGTTTAAGTTTACAGAGCAGAAAGAATTGCGTGCTG

-continued

```
TTATAAACGGTAACTTTGGCGCTGTTGATGTATCACAACACACAAGACAACGTTATACAGAA

GGGCCAATAAATATAGGCGGTCAATCAATATCAGGTAACAGGCATTTATTTGGACACGTGCG

CAATTTACGTATCTGGCATAAGGAACTGACAGATGCACAAATGGGAGAAAGAATATAA
```

STF68B accessory protein 1

(SEQ ID NO: 194)
```
ATGCGAGACTTAACCCTCAAATTCATAAACAAGGCCGACTTTTCGGCCTTTATGGATAGCAT

TGGTTATGAAGATGACGAGGTAATGCAGAACAATGTTCTCATTGATGTGATAGGTAACGTGT

ACAAAGAAACCGGAGAACTTACTGAAGATGGCGAGCCGGTATGTGTTAAGGAAGACGGATA

TTTTGTAAACGTGCGCATCATTAATGATGCAAAAAAATCGTCAATATTCGATAAATACGCGG

TTGTTGTTGAGCATCAACTTCGTGGCTGGATGTGA
```

STF68B accessory protein 2

(SEQ ID NO: 195)
```
ATGGCTACATCGACAGTAATTCCTGATGACATCAAAACGCTAAAATCCGACGTTAGCAAATT

AAAAAACGATCAAGGAAGCTACGCAACAAAATCATATGTAGACAGCAAAGATGAAACCGTT

GGTGACTGGTCTGCTTCATGGTATCAGCAAGTATTGCCAACTAGCGGAGCTATATTTGGGAG

AAAACTCCGCTCAACTCACAGGACGGCAGGTGTTGAGGATGCGTATTGCGAACTATACCTCA

AAAAATGGATAGACAGTCCAGGTAACGCAATGGCGCGCCTTAACCTGAACGATAACGGGAC

AAACATTTGCTGGGACTTTACCAACCTTTATGGCGGTACGATGATTTTTCCCGGTGACAGCG

GATACCTCAAAATGGGTAACTGCCTTATGTCATACAGCAAGCGTGGAAGTAACGCGCTTATT

AAATTTGATTACACCGACACATTACAGATCAAATATGCTAATCATGGGTCAACCATGACATT

AAACACACAGGGAACCGCTCACGCTGGCGTAACAACTAGACTATGGGGTAATTCTAGCCGT

CCGGTTGTTTATGAAGTTGGCGTAGATGAGGCTCTGTATATGTTCTACGCACAGAAAACTAC

CAGCAATACCTACGAATTAACGGTTAACGGCGCGTGCAATGCAAGTGCATTTAATCAAGGCT

CTGACCGGGATCTGAAAGACAATATTCAGGTGATCGATAATGCAACCGACCGCATTCGTAA

AATGAACGGCTATACATACACGCTTAAAGAAAACGGTATGCCTTACGCTGGTGTTATTGCAC

AAGAAACCCTGGAAGCCATCCCCGAAGCCGTAGGGGCTATGATGAAATATCCAGACGGCGG

GAGTGGATTAGATGGAGAAGAAGGTGAACGGTATTACACTGTAGATTATTCTGGTGTTACTG

GCTTGCTTGTTCAGGTAGCCAGAGAGTCAGACGACAGGATAACAGCACTGGAAGAAGAAAA

CGCAGAATTAAGACAAAGATTATCTGCAATTGAGGCGGCGCTTGCGTCTAAATAA
```

>STF90B (SEQ ID NO: 196)
```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA
```

-continued

```
GCAAAATCATCAGAAACGAACGCATCATCAAGTGCCGGTCGTGCAGCTTCCTCGGCAACGG
CGGCAGAAAATTCTGCCAGGGCGGCAAAAACGTCCGAGACGAATGCCAGGTCATCTGAAAC
AGCAGCGGAACGGAGCGCCTCTGCCGCGGCAGACGCAAAAACAGCGGCGGCGGGGAGTGC
GTCAACGGCATCCACGAAGGCGACAGAGGCTGCGGGAAGTGCGGTATCAGCATCGCAGAGC
AAAAGTGCGGCAGAAGCGGCGGCAATACGTGCAAAAAATTCGGCAAAACGTGCAGAAGAT
ATAGCTTCAGCTGTCGCGCTTGAGGATGCGGACACAACGAGAAAGGGGATAGTGCAGCTCA
GCAGTGCAACCAACAGCACGTCTGAAACGCTTGCTGCAACGCCAAAGGCGGTTAAGGTGGT
AATGGATGAGACTAATCGTAAATATACCGCACAGGACGCCACCACCGCGCGAAAAGGCCTT
GTCCAGCTAAGTAGCGTCACCAACAGCGATTCTGAAACGCTTGCGGCAACGCCAAAGGCGG
TTAAGACAGCGTATGACCTTGCTAACGGGAAATACACTGCACAGGATGCCACCACAGCGCG
AAAAGGTCTTGTCCAGCTCAGTAGCGCCACCAACAGCGATTCTGAAACGCTTGCGGCAACAC
CAAAAGCGGTGAAGTCTGCCTATGACAATGCTGAAAAACGTCTTCAGAAAGATCAGAACGG
TGCGGATATTCCGGGAAAGGATACTTTCACGAAAAATATCGGTGCCTGTCGTGCTTATAGCG
GTGCTTTGAGCACTGACGCCGAAACTGGACAACCGCTCAGTTTATTGACTGGCTAGAGTCT
CAGGGAGCCTTTAATCATCCCTACTGGATGTGCAAGTGTTCCTGGTCATACGGTAATAACAA
AATTATTACCGATACTGACTGTGGGACTATTCATCTTGCAGGTTGCGTGATTGAGGTTATGG
GCGTTAAAGCTGCAATGACCATTCGTGTGACCACTCCGAGTACATCAAGCGGTGGTGGTACC
ACCAGTGCGCAATTCACGTATATCAATCACGGAGCTGATTATGCGCCGGGCTGGCGACGCGA
CTACAATACGAAAAATAAGCAACCGGCTTTTGCATTAGGGAAAACAGGAAATACGGTTGCA
AATAATAAAGCGGTAGGATGGAACTGGGACAGTGGTGCTTATTGTGCACAGGATGGCGGAG
CATCAAAAATGGTGCTGCATTTTTACACGGGTGAGGGAAGTTGTCCGGCAATGCAGTTTCTT
GTGGATTATAAAAACAGGGGGATTTTTTACAGGTCGGCACGTGATGGGTATGGATTTGAGGC
TGACTGGTCAGAGTTTTATACCACATCACGAAAGCCAACACCTGCGGATATTCTTGCTCTGG
CATTATCAGGCGGAAGCATGTCAGGCAGCATAAAATTTATCAATGATGCCTTCCTGATTTGG
GAAAGAAACACTGACTGGGCGAAAATTGGATTTAAAAATGATTCAGATGCTGATTCTGACTC
ATACATGTGGTTTGAAACTGGTGATAATGGCAATGAATATTTTAAATGGCGCATCAGGTCTG
GCAGCACAACAAAAGACCTGATGACGCTTAAGTCTGATGCACTACGGGTTACCGGGCAGGT
GATACCATCAAATTTCAGCAATTTTGACTCCCGCTATGTCCGGGATATCCGGCTTGGTGGTGC
CGCCACATACAAACCTGCGAACAATGGCATGACATGGACACATCAGGCACCGTCCGGGTGT
GTATATACCGGCATTATTGTTCAGGATACCGGCTCAAACTCTGCCGATAACATTGGTGGCGT
ATATTCAGACCGGTGCAGAAATACATTAACGGGACATGGTATAACGTGGCGCAGGTATAA
```

STF90B accessory protein (SEQ ID NO: 197)
```
ATGCAGCATTTAAAAAATATTACGGCGGGTAATCCAAAAACGGTTGAACAATATCAATTGA
CAAAGGACTTTGATGTTGTCTGGTTTTTTTCAGAAGATGGTAAGAACTGGTACGAAGAACAA
AAGTATTTTGCTGATGACACGATAAAAATAGCGTACGACAAAGATAATATCATCCGCTATGT
GGAAAAGGATGTGACAGCTATCAGACCGGATGGATTAAGTGTTGTTGAAGTGGCGGATATT
ACTGCTAACCGACGGGCGGATATTTCAGGGAACTGGATGTTTAAGGATGGCACAGTGATCA
AACGAATTTATACGGCAGAGGAATTGCAACAGCAGGCAGAAAACAGGAAAGCCAGACTTCT
TGCAGATGCTGAATCCGTGATTTTGCCGCTGGAGCGCGCTGTCAGGCTGAATATGGCAACAG
AGGAGGAGCGTAGCAGACTGGAAAGATGGGAACGCTACAGCGTTCTGGTCAGTCGTGTGGA
TCCTGCAAATCCCGAATGGCCGGAAATGCCGCAATAA
```

-continued

STF117

(SEQ ID NO: 198)

ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGGTGGT

AATGGATGAGACTAATCGTAAATATACTGCGCAGGATGCCACCACAGCGCGAAAAGGGCTT

GTCCAGCTCAGTAGCGCCACCAACAGTGATTCTGAAACCCTCGCGGCAACGCCAAAAGCAG

TGAAGTCTGCCTATGACAATGCTGAAAAACGTCTTCAGAAAGATCAGAACGGTGCGGATATT

CCGGGAAAGGATACCTTCACGAAAAATATCGGTGCCTGTCGTGCTTATAGCGGCGCTTTGAG

CACTGAAGCCGGAAACTGGACAACCGCTCAGTTTATTGAATGGCTGGATTCCCGTGGTGCAT

TTAATCATCCGTACTGGATGTGCAAAGGCTCCTGGTCATATGCAAATAACAAAATCATTACG

GATACCGGATGTGGTGATATCCACCTGGCTGGTTGTGTCGTCGAGGTCATGGGAACTAAATC

TGCAATCACTATCCGAGTGACCACGCCGACAACATCAAGCGGTGGCGGTACAACCAGCGCG

CAATTCACTTACATTAATCATGGGACGGCTACTCCCCCGGCTGGCGTCGTGACTGGAATCG

TCAGGGCGACGCAATGACCGGAACGATTAATCAGGATGGCGGAAGCCAGAATGCCTATATG

TCTACGGCCTTATGTTCAGGCACCAGAGGCGGCAAAAAATATCTCAGAAAGTTTCGTGGTGG

AGAAGGAGACACTATCTGGCATGAAACAGTACAGGGCGGGGTAGTTCGCTGGGCGACTGGT

AATACTGATGCTCAGGAAGAATTATCACTCAGCTCCGCTTATGGTCTCCGTTCAAGAGGTGA

GATTACATCAAGCAGTGCTAATGGTCTGCGCATTGCTTATGGCAATTATGGATTCTTTATCAG

GAATGATGGCAGCAGCACTTATTTTATGTTGACTAAATCAGGTGACAGATTAGGCACTTATA

ATAATTTAAGACCACTGATTATAAATGATGCCACGGGTGCTGTATCAATGGGGCATGGCCTG

AGTGTTACTGGTGATATTGCCTCAAGTACCAAAGTACGTGCCGGTAGCGGGAAAAAATTCAC

GGTCAGCAGCAGTAATACATCCACGAAGGAAGCCGCATTCAATTTGTGGGGAAACTCAAGT

CGTCCGGTGGTGGCTGAATTAGGTGATGATGCAGGCTGGCATTTTTACAGTCAGAGAAATAC

AGATAACAGCATCACTTTTGCTGTTAACGGGCAGGTATCACCATCTAACTATAGTAATTTTG

-continued

ATTCACGCTATGTCCGGGATATCCGGCTTGGTGGTGCTGCCACATACAAACCTGCGAACAAT
GGCATGACATGGACACATCAGGCACCGTCCGGGTGTGTATATTCCGGCATTATTGTTCAGGA
TACCGGCTCAAACTCTGCCGATAACATTGGTGGCGTATATTACAGACCGGTGCAGAAATACA
TTAACGGGACATGGTATAACGTGGCACAGGTATAA

STF117 accessory protein 1

(SEQ ID NO: 199)
ATGCAGCATTTGATAAATATAACCGCGGGTAATCCAAAAACGGTTGAACAATATCAATTGAC
AAAGGACTTTGATGTTGTCTGGTTTTTTACAGAAGATGGTAAGAACTGGTACGAAGAACAAA
AGTATTTTGCTGATGACACGATAAAAATAGCGTACGACAAGGATAATATTATCCGCTATGTG
GAAAAAGATGTGACAGCTATCAGACCAGATGGATTAAGTGTGGTTGAAGTGGCGGATATTA
CTGCTAACCGACGGGCGGACATTTCAGGGAACTGGATGTTTAAGGACGGCAAAGTGATTAA
ACGCATTTATACGGCAGAGGAATTGCAGCAGCAGGCAGAAAACCGGAAAGCCAGACTTCTT
GCAGATGCTGAATCCGTGATTTTGCCACTGGAGCGCGCTGTCAGGCTGAACATGGCAACAGA
TGAGGAGCGTAGCCGACTGGAAGCATGGGAACGCTACAGTGTTCTGGTCAGCCGTGTGGAT
CCTGCAAATCCTGAATGGCCGGAAATGCCGCAATAA

O111

(SEQ ID NO: 200)
ATGGCAGTAAAGATTTCAGGAGTCCTGAAAGACGGCACAGGAAAACCGGTACAGAACTGCA
CCATTCAGCTGAAAGCCAGACGTAACAGCACCACGGTGGTGGTGAACACGGTGGGCTCAGA
GAATCCGGATGAAGCCGGGCGTTACAGCATGGATGTGGAGTACGGTCAGTACAGTGTCATC
CTGCAGGTTGACGGTTTTCCACCATCGCACGCCGGGACCATCACCGTGTATGAAGATTCACA
ACCGGGGACGCTGAATGATTTTCTCTGTGCCATGACGGAGGATGATGCCCGGCCGGAGGTGC
TGCGTCGTCTTGAACTGATGGTGGAAGAGGTGGCGCGTAACGCGTCCGTGGTGGCACAGAG
TACGGCAGACGCGAAGAAATCAGCCGGCGATGCCAGTGCATCAGCTGCTCAGGTCGCGGCC
CTTGTGACTGATGCAACTGACTCAGCACGCGCCGCCAGCACGTCCGCCGGACAGGCTGCATC
GTCAGCTCAGGAAGCGTCCTCCGGCGCAGAAGCGGCATCAGCAAAGGCCACTGAAGCGGAA
AAAGTGCCGCAGCCGCAGAGTCCTCAAAAAACGCGGCGGCCACCAGTGCCGGTGCGGCGA
AAACGTCAGAAACGAATGCTGCAGCGTCACAACAATCAGCCGCCACGTCTGCCTCCACCGC
GGCCACGAAAGCGTCAGAGGCCGCCACTTCAGCACGAGATGCGGTGGCCTCAAAAGAGGCA
GCAAAATCATCAGAAACGAACGCATCATCAAGTGCCGGTCGTGCAGCTTCCTCGGCAACGG
CGGCAGAAAATTCTGCCAGGGCGGCAAAAACGTCCGAGACGAATGCCAGGTCATCTGAAAC
AGCAGCGGAACGGAGCGCCTCTGCCGCGGCAGACGCAAAAACAGCGGCGGCGGGGAGTGC
GTCAACGGCATCCACGAAGGCGACAGAGGCTGCGGGAAGTGCGGTATCAGCATCGCAGAGC
AAAAGTGCGGCAGAAGCGGCGGCAATACGTGCAAAAAATTCGGCAAAACGTGCAGAAGAT
ATAGCTTCAGCTGTCGCGCTTGAGGATGCGGACACAACGAGAAAGGGGATAGTGCAGCTCA
GCAGTGCAACCAACAGCACGTCTGAAACGCTTGCTGCAACGCCAAAGGCGGTTAAGGTGGT
AATGGATGAGACTAATCGTAAGGCACCTCTGGACAGTCCGGCACTGACCGGAACGCCAACA
GCACCAACCGCGCTCAGGGGAACAAACAATACCCAGATTGCGAACACCGCTTTTGTACTGG
CCGCGATTGCAGATGTTATCGACGCGTCACCTGACGCACTGAATACGCTGAATGAACTGGCC
GCAGCGCTCGGGAATGATCCAGATTTTGCTACCACCATGACTAACGCGCTTGCGGGTAAACA
ACCGAAGAATGCGACACTGACGGCGCTGGCAGGGCTTTCCACGGCGAAAAATAAATTACCG
TATTTTGCGGAAAATGATGCCGCCAGCCTGACTGAACTGACTCAGGTTGGCAGGGATATTCT
GGCAAAAAATTCCGTTGCAGATGTTCTTGAATACCTTGGGGCCGGTGAGAATTCGGCATCAG

```
GTGCATTACAGAAGAATCAAAACGGTGCAGACATTCCGGGCAAAGATACCTTTACCAAGAA

TATCGGTGCTTGTCGTGCTTATTCGGCATGGCTTAATATCGGAGGTGATTCTCAGGTATGGAC

TACGGCTCAGTTTATCTCTTGGCTCGAGAGTCAGGGTGCGTTTAATCATCCGTACTGGATGTG

CAAAGGCTCTTGGGCGTACGCGAACAACAAAGTCATCACCGACACTGGTTGTGGTAACATCT

GTCTGGCGGGTGCAGTAGTGGAAGTTATCGGTACGCGCGGTGCGATGACGATCCGTGTAACT

ACTCCATCTACCTCCTCCGGTGGCGGTATCACCAACGCCCAGTTCACTTACATTAACCACGG

CGATGCCTATGCTCCGGGCTGGCGCCGTGATTACAACACTAAAAACCAACAACCTGCGTTTG

CACTGGGTCAGACGGGTAGTCGTGTGGCGAACGATAAAGCGGTCGGTTGGAATTGGAACTC

TGGTGTGTACAACGCTGATATTAGTGGAGCTTCTACTCTGATCCTTCATTTTAACATGAATGC

TGGAAGTTGTCCGGCAGTGCAGTTTCGTGTTAACTATCGTAATGGAGGAATCTTTTACCGCTC

TGCACGTGACGGCTACGGCTTCGAAGCGAACTGGAGTGAATTTTACACGACCACTCGTAAGC

CGAGTGCTGGAGATGTGGGAGCTTATACTCAGGCAGAATGCAATTCGCGTTTCATTACTGGT

ATTCGTCTGGGAGGTTTAAGTTCCGTGCAGACTTGGAACGGTCCAGGTTGGAGTGATCGTAG

TGGCTATGTTGTGACAGGCAGTGTTAACGGCAACCGTGACGAACTGATCGACACTACTCAAG

CGCGTCCGATCCAGTACTGCATTAACGGAACTTGGTATAACGCGGGAAGTATCTAA
```

O111 accessory protein (SEQ ID NO: 201)
```
ATGATGCACTTAAAAAACATTACTGCTGGCAACCCTAAAACAAAAGAGCAATACCAGCTAA

CGAAACAATTTAACATCAAATGGCTTTATTCAGAGGATGGAAAAAACTGGTATGAGGAACA

AAAGAATTTCCAGCCAGACACTTTGAAAATGGTTTATGACCATAACGGCGTTATTATTTGTA

TTGAAAAGGATGTTTCAGCAATTAATCCGGAAGGCGCAAGCGTCGTTGAATTACCTGATATT

ACAGCAAATCGCCGTGCTGACATTTCGGGTAAATGGATGTTCAAAGATGGCGTAGTGGTAA

AGCGTACTTACACAGAAGAAGAGCAACGTCAACAGGCGGAAAATGAAAAGCAAAGCCTGC

TACAGCTCGTCAGGGATAAAACCCAGCTATGGGACAGTCAGCTACGGCTGGGCATCATTTCC

GACGAGAATAAACAAAAATTAACAGAGTGGATGCTCTTTGCGCAGAAAGTCGAATCTACAG

ACACTTCCAGCCTGCCAGTAACGTTTCCCGAACAACCAGAATGA
```

DC1

(SEQ ID NO: 202)
```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC
```

-continued

```
AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGGCAGC

ATATGACCTTGCTAACGGGAAATACACTGCACAGGACGCCACCACAGCGCGAAAAGGTCTT

GTCCAGCTCAGTAGCGTCACCAACAGTGATTCTGAAACCCTCGCGGCAACGCCAAAAGCAG

TGAAGTCTGCCTATGACAATGCTGAAAAACGTCTTCAGAAAGATCAGAACGGTGCGGATATT

CCGGGAAAGGATACCTTCACGAAAAATATCGGTGCCTGTCGTGCTTATAGCGGCGCTTTGAG

CACTGAAGCCGGAAACTGGACAACCGCGCAGTTTATTGACTGGCTAGAGTCTCAGGGAGCC

TTTAATCATCCCTACTGGATGTGCAAGTGTTCCTGGTCATACGGTAATAACAAAATTATTACC

GATACTGACTGTGGGACGATTCATCTTGCAGGTTGCGTGATTGAGGTTATGGGTGTTAAAGC

AGCAATGACCATTCGTGTGACCACTCCGAGTACATCAAGCAGTGGTGGTACCACCAGTGCGC

AATTCACGTATATCAATCACGGAGCTGATTATGCGCCGGGCTGGCGACGCGACTACAATACG

AAAAATAAGCAACCGGCTTTTGCATTAGGGAAAACAGGAAATACGGTTGCAAATAATAAAG

CAGTAGGATGGAACTGGGACAGTGGTGCTTATTGTGCACAGGATGGCGGAGCATCAAAAAT

GGTGCTGCATTTTTACACGGGTGAGGGAAGTTGTCCGGCAATGCAGTTTCTTGTGGATTATA

AAAACAGGGGGATTTTTTACAGGTCGGCACGTGATGGGTATGGATTTGAGGCTGACTGGTCA

GAGTTTTATACCACATCACGAAAGCCAACACCTGCGGATATTCTTGCTCTGGCATTATCAGG

CGGAAGCATGTCAGGCAGCATAAAATTTATCAATGATGCCTTCCTGATTTGGGAAAGAAACA

CTGACTGGGCGAAAATTGGATTTAAAAATGATTCAGATGCTGATTCTGACTCATACATGTGG

TTTGAAACTGGTGATAATGGCAATGAATATTTTAAATGGCGCATCAGGTCTGGCAGCACAAC

AAAAGACCTGATGACGCTTAAGTCTGATGCACTACGGGTTACCGGGCAGGTGATACCATCA

AATTTCAGCAATTTTGACTCCCGCTATGTCCGGGATATCCGGCTTGGTGGTGCCGCCACATAC

AAACCTGCGAACAATGGCATGACATGGACACATCAGGCACCGTCCGGGTGTGTATATACCG

GCATTATTGTTCAGGATACCGGCTCAAACTCTGCCGATAACATTGGTGGCGTATATTACAGA

CCGGTTCAGAAATACATTAACGGGACGTGGTACAACGTGGCGCAGGTA
```

DC1 accessory protein 1

(SEQ ID NO: 203)

```
ATGCAGCATTTGATAAATATAACGGCAGGTAATCCAAAAACGGTTGAACAATATCAATTGA

CAAAGGACTTTGATGTTGTCTGGTTTTTTTCAGAAGATGGTAAGAACTGGTACGAAGAACAA

AAGTATTTTGCTGATGACACGATAAAAATAGCGTACGACAAAGATAATATTATCCGCTATGT

GGAAAAGGATGTGACAGCTATCAGACCAGATGGATTAAGTGTTGTTGAAGTGCCGGATATT

ACTGCTAATCGACGGGCGGACATTTCAGGGGGCTGGATGTTTAAGGACGGCAAAGTGATTA

AACGCATTTATACGGCAGAGGAATTGCAGCAGCAGGCAGAAAACCGGAAAGCCAGACTTCT

TGCAGATGCTGAATCCGTGATTTTGCCGCTGGAGCGCGCGGTCAGACTGAACATGGCAACAG

ATGAGGAGCGTAGCCGACTGGATGCATGGGAGCGTTACAGCGTTCTGGTCAGTCGTGTGGAT

CCTGCAAATCCTGAATGGCCGGAAATGCCGCAATAA
```

STF94A (SEQ ID NO: 204)

```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC
```

```
-continued
CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA

GCAGTGCAACCAACAGCACGTCTGAAACGCTTGCTGCAACGCCAAAGGCGGTTAAGGTGGT

AATGGATGAGACTAATCGTAAATATACCGCACAGGACGCCACCACAGCGCGAAAAGGCCTT

GTTCAGCTGAGTAGCGCCATCAACAGCGATTCTGAAACGCTTGCGGCAACGCCAAAGGCGG

TTAAGACAGCGTATGACCTTGCTAACAGGAAATACACTGCACAGGATGCCACCACAGCGCG

AAAAGGTCTTGTCCAGCTAAGTAGCGCCACCAACAGTGATTCTGAAACGCTGGCCGCAACAT

CAAAAGCGGTGAAGTCTGCCTATGACAATGCTGAAAAACGTCTTCAGAAAGATCAGAATGG

TGCGGATATTCCGGGAAAGGATACCTTCACGAAAAATATCGGTGCCTGTCGTGCTTATAGCG

GCGCTTTGAGCACTGAAGCCGGAAACTGGACAACCGCTCAGTTTATTGAATGGCTGGATTCC

CGTGGTGCATTTAATCATCCGTACTGGATGTGCAAAGGCTCCTGGTCATATGCAAATAACAA

AATCATTACGGATACCGGATGTGGTGATATCCACCTGGCTGGTTGTGTCGTCGAGGTCATGG

GAACTAAATCTGCAATCACTATCCGAGTGACCACACCGACAACATCAAGCGGTGGCGGTAC

AACCAGCGCACAATTCACTTACATTAATCATGGGACGGCTACTCCCCCGGCTGGCGTCGTG

ACTGGAATCGTCAGGGCGACGCAATGACCGGAACGATTAATCAGGACGGTGGAAGCCAGAA

TGCCTATATGTCTACGGCCTTATGTTCAGGCACAAGAGGCGGCAAAAAATATCTCAGAAAGT

TTCGTGGTGGAGAAGGAGACACTATCTGGCATGAAACAGTACAGGGCGGGGTAGTTCGTTG

GGCGACTGGTAATACTGATGCTCAGGAAGAATTATCACTCAGCTCCGCTTATGGTCTCCGTT

CAAGAGGTGAGATTACATCACTCAGTGCTAATGGTCTGCGCATTGCTTATGGCAATTATGGT

TTCTTTATCAGGAATGATGGCAGCAGCACTTATTTTATGTTGACTAAATCAGGTGACAGATT

AGGAACTTATAATAATTTAAGACCGCTGATTATAAATGATGCCACTGGTGCTGTATCAATGG

GGCATGGCCTGAATGTTACTGGTGATATTGTCTCAAGTACCAAAGTACGTGCCGGTAGCGGG

AAAAAATTCACGGTCAGCAGCAGTAATACATCCACGAAGGAAGCCGCATTCAATTTGTGGG

GAAACTCAAGTCGTCCGGTGGTGGCTGAATTAGGTGATGATGCAGGCTGGCATTTTTACAGT

CAGAGAAATACAGATAACAGCATCACTTTTGCTGTTAACGGGCAGGTATCACCATCTAACTA

TGGCAACTTTGATTCACGCTATGTCCGGGATATCCGGCTTGGTGGTGCTGCCACATACAAAC

CTGCGAACAATGGCATGACATGGACACATCAGGCACCGTCCGGGTGTGTATATTCCGGCATT
```

-continued

ATTGTTCAGGATACCGGCTCAAACTCTGCCGATAACATTGGTGGCATATATTACAGACCGGT

GCAGAAATACATTAACGGGACATGGTATAACGTAGCGCAGGTATAA

>STF94A accessory protein (SEQ ID NO: 205)

ATGCAGCATTTGATAAATATAATGGCGGGTAATCCAAAAACAGTTGAACAATATCAATTGAC

AAAGGGCTTTGATGTTGTCTGGTTTTTTACAGAAGATGGTAAGAACTGGTACGAAGAACAAA

AGTATTTTGCTGATGACACGATAAAAATAGCGTACGACAAAGATAATATCATCCGCTATGTG

GAAAAGGATGTGACAGCTATCAGACCGGATGGATTAAGTGTGGTTGAAGTGGCGGATATTA

CTGCTAACCGACGGCGGATATTTCAGGGGGCTGGATGTTTAAGGACGGCAAAGTGATTAA

ACGCATTTATACGGCGGAGGAATTACAGCAGCAGGCAGAAATTCGGAAAGCCAGACTTCTT

GCAGATGCTGAATCCGTGATTTTGCCGCTGGAGCGCGCGGTCAGACTGAACATGGCAACAG

AGGAGGAGCGCACACGGCTGGAGGCTTGGGAACGCTACAGCGTTCTGGTCAGTCGTGTGGA

TCCTGCAAATCCTGAATGGCCGGAAATGCCGCAATAA

STF69A (SEQ ID NO: 206)

GCTTCTGCCACTGCATCAGCTAACAGTCAAAAAGCAGCAAAAACCAGTGAAACCAACGCAA

AGGCGAGCGAAACAGCGGCTGCGAACTCAGCGAAAGCATCGGCAGCAAGCCAGACGGCAG

CTAAAGCAAGCGAAGATGCAGCCAGAGAGTACGCAAGCCAGGCTGCGGAGCCGTATAAATA

TGTCTTACAGCCGTTACCTGAGGTGTGGATACCGTTTAACGATTCACTGGATATGATTACCG

GGTTTGCTCCTGGATATAAGAGCATCACAGTTGGTGACGATGTTATTGCATTGCCGTCTGAA

AAGGTTGTTTCATTTACCAGGGCGTCAACTGCAACGTATATAGATAAGTCTGGGTGTTTTGCT

GAATCAGCGATAAATGAACCACGTTTTGAAAAAGATGGTCTGCTCATTGAAGGTCAGAGAA

CGAATACTTTTTCTTATACGAATACACCAGTATCGTGGAACTATGACACTGCTAACTTAACTA

TTACCACGGGAGTTGATGAGTATGGTTTCAGTTATGGTTTGTTTGGCGTTAAAGAAACATCC

ACAACTGAAAGGGCGACATTAATTTCTACTGGATATACCAGGGTTATTTCAGTTTCGGCAAA

TGAATCAGTTACTTTATCCTGCAGAGTTAAAAAAGTAAGTGGGGATGGTATTATCACGTTGC

GTCCAAGAATATCATATGTTAACGACGATGGCTCAAGTAACACACTGACCGCTGGCGCATAT

ATTGATTGCGAGACTGGCGATATGTTGAGTTATTCTGGAGGTGAGGCGGCAACTTATAACAT

ATTCAGAGAGTCTAATGGATGGATTCGTGTTGAGTTTACCTACAAATCACCAGAAGCAAAAA

ATATGTATGGGCGTTTTGAGTTTGGAGCACATCAACGATCAATCAAGTCTGGCGATAAATTA

ATGTTAACAACCCCTCAATTCGAAAAGGGACTAAACGCGTCATCTTTTATCATCACAACAGA

GGTCGGTGCCACGAGAGCAAGTGACCAGGTAATCATACCTATACCTTTCAATTGGGCAACTC

CACCAGTTAGTGTTCTCATGGAAGTTAATGTTAATTGGGATTCTGAAATGCCTAATTTAGAA

GGCTCTGCGCGTTTGCTTAATATCTCAATTACAGGGGCGACGACTGAAGTTTCTGATGAAAG

TTATATGTATTTTGGTTTTACCACTCGTGGTAAAAGGCTAATTATCACCAATGGCAAAGGAA

CAAAAACAGAATATAAAGCATATGGGAATAGAGAGAAAAGGAAATTTGTTACTGGCTTTAA

GTTTACAGAAGATAAACAGTTGCAGGTTGTTGTTGATGGAATTTTAGGTGGCAGCTCCCCGT

CTCTGCATACATTGCAACGTTATACTGCCGGTAATATTAATATCGGTGGACAATCATCCAGT

GGCAACAGACACCTGTTCGGTCATGTGAAAAATTTACGCATTTGGCATAAAGAATTAACTGA

GGCACAAATGGGGGAGTCAATCTAA

>STF69A accessory protein 1

(SEQ ID NO: 207)

ATGAAAGATTTAACACTCAAATTTGAAGACAGGGCCGACTTTTCGGCCTTTATGGAGAGTAT

TGGCTATTATGATGACGAGTCGATGCAGGATGATATTCTTATCGACGTGATAGGTAACGTGT

```
ACAAAGAAACCGGAGAACTGACTGAAGATGGCGAACCGGTATGTGTTAAGGAAGACGGAT

ATTTTGTAAACGTGCGCATCATTAATGATTCGCAAATATCGTCATTATTCGATGAATACGTGG

TTGCTGTTGAGCATCAACTTCGTGGCTGGATGTGA
```

>STF69A accessory protein 2
(SEQ ID NO: 208)
```
ATGGCTACATCGACAGTAATTCCTGATGACATCAAAACGCTAAAATCCGACGTTAGCAAATT

AAAAAACGATCAAGGAAGCTACGCAACAAAATTATATGTAGACAGCAAAGATGAAATCGTT

GGTGACTGGTCTGCTTCATGGTATCAGCAGGTATTGCCAACTAGCGGAGCTATATTTGGGAG

AAAACTCCGCTCAACTCACAGGACGGCAGGTGTTGAGGATGCGTATTGCGAACTATACCTCA

AAAAATGGATAGACAGTCCAGGTAACGCAATGGCGCGCCTTAACCTGAACGATAACGGGAC

AAACATTTGCTGGGACTTTACCAACCTTTATGGCGGTACGATGATTTTTCCCGGTGACAGCG

GATACCTCAAAATGGGTAACTGCCTTATGTCATACAGCAAGCGTGGAAGTAACGCGCTTATT

AAATTTGATTACACCGACACATTACAGATCAAATATGCCAATCATGGGTCAACCATGACATT

AAACACACAGGGAACCGCTTATGCTGGTGTTACTGCTCAATTGTGGGCAACTCCAGCCGTC

CTGTTGTTTATGAAGTCGGTGTTGATGGTGGCGCTTATATGTTCTATGCGCAGAAAAATACC

GATAACACCTATATGTTAAGCGTTAATGGTGCATGTCATGCCACCGCATTTAACCAGCATTC

CGACCGGGATCTGAAAGACAACATTCAGGTGATCGATAATGCAACCGACCGCATCCGTAAA

ATGAACGGCTATACATACACGCTTAAAGAAAACGGTATGCCCTATGCTGGTGTCATTGCACA

GGAAGCTCTGGAAGCAATCCCAGAAGTTGTAGGTTCCGCAATGAAATATCAGGACGGTGCG

AGCGGATCGGAAGGTGAAGAAGGTGAACGTTATTACACAGTAGATTATTCTGGTGTTACTGG

CTTGCTTGTTCAGGTAGCCAGAGAGTCAGACGACAGAATAACAGCACTGGAAGAAGAAAAC

GCAGAATTAAGACAAAGATTATCTGCAATTGAGGCGGCGCTTGCGTCTAAATAA
```

>STF118
(SEQ ID NO: 209)
```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGACGCAAAAACAGCGGCGGCGGGGAGTGC

GTCAACGGCATCCACGAAGGCGACAGAGGCTGCGGGAAGTGCGGTATCAGCATCGCAGAGC

AAAAGTGCGGCAGAAGCGGCGGCAATACGTGCAAAAAATTCGGCAAAACGTGCAGAAGAT

ATAGCTTCAGCTGTCGCGCTTGAGGATGCGGACACAACGAGAAAGGGGATAGTGCAGCTCA
```

```
GCAGTGCAACCAACAGCACGTCTGAAACGCTTGCTGCAACGCCAAAGGCGGTTAAGGTGGT

AATGGATGAGACTAATCGTAAAGCGCCATTAAACAGCCCTGCACTGACCGGAACGCCAACG

ACGCCAACTGCGCGACAGGGAACGAATAATACTCAGATCGCAAACACGGCTTTCGTTATGG

CCGCGATTGCCGCCCTTGTAGACTCGTCGCCTGACGCACTGAATACGCTGAACGAGCTGGCA

GCGGCGCTGGGCAACGACCCGAATTTTGCTACCACTATGACTAATGCGCTTGCGGGTAAGCA

ACCGAAAGATGCTACCCTGGCGGCGCTGGCGGGGCTTGCTACTGCGGCAGACAGGTTTCCGT

ATTTTACGGGGAATGATGTTGCCAGTCTGGCAACTCTGACAAAAGTCGGGCGGGATATTCTT

GCGAAATCGACCGTTTCCGCCGTTATCGAATATCTCGGTTTACAGGAAACGGTAAACCGAGC

CGGGAACGCCGTGCAAAAAAATGGCGATACCTTGTCCGGTGGACTTACTTTTGAAAACGACT

CAATCCTTGCCTGGATTCGAAATACTGACTGGGCGAAGATTGGATTTAAAAATGATGCCGAT

GGTGACACTGATTCATATATGTGGTTTGAAACAGGTGACAACGGCAATGAATACTTCAAATG

GAGAAGTCGCCAGAGCACCACAACAAAAGACCTGATGAATCTTAAATGGGATGCTCTGTAT

GTTCTTGTTAAAGCCCTTTTCAGCAGTGAAGTAAAAATATCTACAGTCAATGCACTGAGGAT

ATTTAATTCATCTTTTGGTGCTATTTTTCGCCGTTCTGAAGAAAACCTGTATATCATCCCTAC

ACGAGAAAATGAGGGTGAAAATGGAGATATTGGGCCATTAAGGCCATTCGGCATCAACTTA

AGAACAGGAGTTGTGTCTGTTGGTAATGGTGCCAGGATTGATGGCGGGCTGGCACTTGGCAC

GAATAACGCGTTGGGTGGGAACTCTATTGTTCTTGGTGATAACGACACCGGATTTAAACAAA

ATGGCGATGGTAATCTGGATGTTTATGCTAATAACGTCCATGTTATGCGCTTTGTTTCCGGAA

GCATTCAAAGTAATAAGACCATAAATATTACGGGGCGTGTTAATCCCTCGGATTACGGTAAC

TTTGATTCCCGCTATGTGAGAGATATCAGACTTGGCACACGTGTTGTCCAGACCATGCAGAA

AGGGGTGATGTATGAGAAAGCAGGGCACGTAATTACCGGGCTTGGTATTGTCGGTGAAGTC

GATGGTGATGACCCCGCAGTATTCAGGCCAATACAAAAATACATCAATGGCACATGGTATA

ACGTCGCACAGGTGTAA

>STF118 accessory protein
                                                    (SEQ ID NO: 210)
ATGCAGCATTTAAAAAATATTACTGCGGGTAATCCAAAAACTGTTGCCCAATATCAACTGAC

AAAAAATTTTGATGTTATCTGGTTATGGTCCGAAGAGGGAAAAAACTGGTATGAGGAAGTA

AGTAATTTTCAGGAAGACACGATAAAGATTGTTTACGACGAGAATAATATAATTGTCGGCAT

CACCAGAGATGCTTCAACGCTTAACCCTGAAGGTTTCAGCGTTGTCGAGGTTCCTGATATTA

CCTCCAACCGACGTGCTGATGACTCAGGTAAATGGATGTTTAAGGATGGTGCCGTGATTAAG

CGGATTTATACGGCAGATGAACAGGAGCAACAGGCAGAATCACAAAAGGCAGCTTTACTTT

CCGAAGCTGAATCCGTGATTTTGCCGCTGGAACGCGCTGTCAGGCTGAATATGGCGACGGAT

GAGGAACGCAGCCGACTGGAAGCATGGGAACGCTACAGCGTTCTGGTCAGTCGTGTGGATC

CTGCAAATCCCGAATGGCCGGAAATGCCGCAATAA

K1F
                                                    (SEQ ID NO: 211)
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC
```

-continued

```
CTTGTGACTGATGCAACTGACTCAGCACGCGCCGCCAGCACGTCCGCCGGACAGGCTGCATC
GTCAGCTCAGGAAGCGTCCTCCGGCGCAGAAGCGGCATCAGCAAAGGCCACTGAAGCGGAA
AAAAGTGCCGCAGCCGCAGAGTCCTCAAAAAACGCGGCGGCCACCAGTGCCGGTGCGGCGA
AAACGTCAGAAACGAATGCTGCAGCGTCACAACAATCAGCCGCCACGTCTGCCTCCACCGC
GGCCACGAAAGCGTCAGAGGCCGCCACTTCAGCACGAGATGCGGTGGCCTCAAAAGAGGCA
GCAAAATCATCAGAAACGAACGCATCATCAAGTGCCGGTCGTGCAGCTTCCTCGGCAACGG
CGGCAGAAAATTCTGCCAGGGCGGCAAAAACGTCCGAGACGAATGCCAGGTCATCTGAAAC
AGCAGCGGAACGGAGCGCCTCTGCCGCGGCAGACGCAAAAACAGCGGCGGCGGGGAGTGC
GTCAACGGCATCCACGAAGGCGACAGAGGCTGCGGGAAGTGCGGTATCAGCATCGCAGAGC
AAAAGTGCGGCAGAAGCGGCGGCAATACGTGCAAAAAATTCGGCAAAACGTGCAGAAGAT
ATAGCTTCAGCTGTCGCGCTTGAGGATGCGGACACAACGAGAAAGGGGATAGTGCAGCTCA
GCAGTGCAACCAACAGCACGTCTGAAACGCTTGCTGCAACGCCAAAGGCGGTTAAGGTGGT
AATGGATGAGACTAATCGTAAGGCACCTCTGGACAGTCCGGCACTGACCGGAACGCCAACA
GCACCAACCGCGCTCAGGGGAACAAACAATACCCAGATTGCGAACACCGCTTTTGTACTGG
CCGCGATTGCAGATGTTATCGACGCGTCACCTGACGCACTGAATACGCTGAATGAACTGGCC
GCAGCGCTCGGGAATGATCCAGATTTTGCTACCACCATGACTAACGCGCTTGCGGGTAAACA
ACCGAAGAATGCGACACTGACGGCGCTGGCAGGGCTTTCCACGGCGAAAAATAAATTACCG
TATTTTGCGGAAAATGATGCCGCCAGCCTGACTGAACTGACTCAGGTTGGCAGGGATATTCT
GGCAAAAAATTCCGTTGCAGATGTTCTTGAATACCTTGGGGCCGGTGAGAATTCGGGTGCGA
AGGGCGATGGCGTTACCGACGACACTGCAGCGCTGACTTCCGCCCTGAACGATACTCCGGTG
GGTCAGAAAATCAACGGTAACGGTAAAACTTATAAAGTTACGTCCCTGCCGGACATCTCCCG
CTTTATCAACACCCGTTTCGTGTATGAACGTATCCCAGGCCAGCCGCTGTACTACGCATCGG
AAGAGTTCGTTCAGGGTGAGCTTTTTAAAATCACCGACACTCCGTATTATAACGCCTGGCCA
CAGGATAAGGCTTTCGTGTACGAAAACGTTATCTATGCTCCGTACATGGGTTCCGACCGTCA
CGGTGTCAGCCGACTGCACGTAAGCTGGGTGAAATCGGGCGACGATGGTCAGACCTGGAGC
ACGCCTGAGTGGCTGACCGACCTTCATCCGGACTATCCGACCGTTAACTATCACTGCATGAG
CATGGGCGTCTGTCGCAACCGTCTGTTCGCAATGATCGAAACCCGTACGCTGGCAAAAAACG
CTCTGACTAACTGCGCCCTGTGGGATCGTCCAATGAGCCGCTCTCTGCACCTGACGGGTGGT
ATTACCAAAGCAGCGAACCAGCGTTACGCCACCATTCACGTACCGGATCATGGTCTGTTCGT
TGGTGACTTTGTAAATTTCTCTAATTCTGCAGTTACCGGTGTGTCTGGCGACATGACCGTTGC
GACCGTAATCGATAAGGACAATTTCACCGTCCTGACCCCGAACCAGCAAACCTCTGATCTTA
ACAACGCTGGCAAGAACTGGCACATGGGCACTAGCTTTCACAAATCTCCGTGGCGTAAAAC
CGATCTGGGCCTGATCCCGTCTGTAACTGAAGTGCACTCCTTCGCGACCATTGATAACAACG
GTTTCGCTATGGGTTATCACCAAGGTGATGTTGCACCGCGTGAAGTCGGCCTCTTTTATTTTC
CGGACGCATTCAACAGCCCGTCCAACTACGTGCGCCGTCAGATTCCGTCTGAATATGAACCG
GACGCCTCCGAGCCGTGCATTAAGTACTATGACGGTGTGCTGTACCTGATTACCCGTGGCAC
CCGTGGTGATCGTCTGGGTTCATCTCTGCATCGCTCCCGCGACATTGGTCAGACGTGGGAAA
GTCTGCGCTTCCCGCACAATGTTCATCACACCACCCTGCCGTTCGCGAAAGTCGGCGATGAC
CTGATCATGTTTGGCTCCGAACGTGCTGAAAACGAATGGGAAGCGGGCGCCCCAGACGATC
GCTACAAGGCATCTTACCCGCGCACCTTCTACGCGCGTCTGAACGTGAACAACTGGAACGCA
```

-continued

```
GACGATATCGAATGGGTAAACATCACCGACCAGATCTACCAGGGTGGTATCGTGAACTCTG

GTGTGGGCGTTGGTTCCGTTGTAGTTAAAGATAACTACATCTATTATATGTTCGGCGGCGAA

GACCACTTCAACCCGTGGACTTACGGCGATAACTCCGCGAAAGACCCGTTCAAATCCGATGG

TCACCCTTCTGACCTCTATTGTTACAAAATGAAAATCGGTCCGGACAACCGTGTTTCCCGCG

ATTTTCGCTACGGCGCTGTTCCAAACCGTGCAGTTCCGGTATTCTTCGACACGAACGGCGTG

CGTACCGTTCCGGCTCCGATGGAATTCACCGGCGACCTGGGTCTGGGCCACGTAACCATTCG

TGCCTCCACCAGCTCTAACATCCGTTCCGAAGTACTCATGGAAGGTGAATACGGCTTTATCG

GTAAGTCTATCCCGACGGACAACCCGGCAGGTCAGCGTATCATCTTCTGCGGCGGTGAGGGT

ACCTCTAGCACCACCGGCGCGCAAATCACCCTGTACGGCGCTAACAACACCGACTCTCGTCG

TATCGTATACAACGGTGATGAACATCTGTTCCAGTCCGCAGACGTGAAACCGTACAACGACA

ACGTCACCGCACTGGGTGGTCCATCCAACCGTTTCACCACTGCGTACCTGGGTTCCAACCCG

ATCGTTACTAGCAATGGTGAACGCAAAACTGAACCGGTAGTGTTTGACGACGCTTTTCTGGA

CGCATGGGCGATGTTCATTACATCATGTATCAGTGGCTGGATGCCGTGCAGCTGAAAGGTA

ACGACGCGCGTATCCACTTTGGTGTGATCGCACAGCAGATTCGCGATGTCTTCATCGCACAC

GGTCTGATGGATGAAAATAGTACTAACTGTCGCTATGCGGTGCTGTGCTATGACAAATACCC

GCGTATGACCGACACCGTGTTCTCGCACAATGAGATTGTTGAACATACCGATGAAGAAGGTA

ACGTGACTACTACCGAAGAACCGGTTTATACCGAAGTGGTTATTCACGAAGAAGGTGAAGA

ATGGGGCGTGCGTCCTGATGGTATCTTTTTCGCGGAGGCAGCGTACCAGCGTCGCAAACTGG

AACGCATCGAAGCTCGTCTGTCGGCACTGGAACAGAAA
```

STF66

(SEQ ID NO: 212)

```
ATGGCAGTAAAGATTTCAGGAGTCCTGAAAGACGGCACAGGAAAACCGGTACAGAACTGCA

CCATTCAGCTGAAAGCCAGACGTAACAGCACCACGGTGGTGGTGAACACGGTGGGCTCAGA

GAATCCGGATGAAGCCGGGCGTTACAGCATGGATGTGGAGTACGGTCAGTACAGTGTCATC

CTGCAGGTTGACGGTTTTCCACCATCGCACGCCGGGACCATCACCGTGTATGAAGATTCACA

ACCGGGGACGCTGAATGATTTTCTCTGTGCCATGACGGAGGATGATGCCCGGCCGGAGGTGC

TGCGTCGTCTTGAACTGATGGTGGAAGAGGTGGCGCGTAACGCGTCCGTGGTGGCACAGAG

TACGGCAGACGCGAAGAAATCAGCCGGCGATGCCAGTGCATCAGCTGCTCAGGTCGCGGCC

CTTGTGACTGATGCAACTGACTCAGCACGCGCCGCCAGCACGTCCGCCGGACAGGCTGCATC

GTCAGCTCAGGAAGCGTCCTCCGGCGCAGAAGCGGCATCAGCAAAGGCCACTGAAGCGGAA

AAAAGTGCCGCAGCCGCAGAGTCCTCAAAAAACGCGGCGGCCACCAGTGCCGGTGCGGCGA

AAACGTCAGAAACGAATGCTGCAGCGTCACAACAATCAGCCGCCACGTCTGCCTCCACCGC

GGCCACGAAAGCGTCAGAGGCCGCCACTTCAGCACGAGATGCGGTGGCCTCAAAAGAGGCA

GCAAAATCATCAGAAACGAACGCATCATCAAGTGCCGGTCGTGCAGCTTCCTCGGCAACGG

CGGCAGAAAATTCTGCCAGGGCGGCAAAAACGTCCGAGACGAATGCCAGGTCATCTGAAAC

AGCAGCGGAACGGAGCGCCTCTGCCGCGGCAGCTTCTGCCACTGCAGCAGCCAACAGTCAA

AAAGCTGCAAAAACCAGTGAAACCAACTCAAAGGCGAGCGAAACAGCGGCTGCGAACTCA

GCGAAAGCATCGGCAGCAAGCCAGACGGCTGCAAAAGCAAGTGAGGATGCAGCCAGAGAG

TATGCAAGCCAGGCTGCGGAGCCGTATAAACAAGTTTTGCAGCCGCTTCCCGATGTGTGGAT

ACCGTTTAACGATTCACTGGATATGATTACGGGCTTTTCGCCGTCATATAAAAAGATTGTTAT

TGGTGATGATGAAATAACGATGCCTGGCGATAAGGTTGTAAAGTTTAAACGCGCATCGAAA

GCAACCTATATTAATAAATCTGGTGTGCTGACAGAGGCTGCCATTGACGAGCCACGATTTGA
```

```
ACGTGATGGCCTGCTTATTGAGGGGCAAAGAACAAACTACATGCTCAATTCGGAAAACCCT

GCCAGTTGGGGGCGATCGTCAAATATGGATGTTCCCGAAACCGGGACGGATAGTTTTGGTTT

TACCTATGGAAAGTTTGTCTGCAACGATTCTCTGATTGGGCAAACCTCAGCCATTAATATGG

CATCAATTGCTGCAACAAAGTCAGTTGATGTCTCAGGCGATAATAAATACGTGACAACCTCA

TGTCGTTTTAAAACAGAACTGCAGGTAAGGTTGCGTATCCGATTTGATAAATATGACGGTAG

CGCAACAACTTTTCTTGGTGATGCGTATATTGATACACAAACGCTTGAAATTAATATGACAG

GTGGTGCTTCCGGTAGAATTACGGCACGAGTCAGGAAGGATGAAACTACAGGATGGATTTTT

GCTGAGGCAACAATTCAGGCAATTGATGGTGAGTTAAAAATAGGCTCTCAGATACAGTATTC

ACCTAAGCAGGGAGGGGCAACCGTATCAGGTGACTATATTTATCTGGCTACCCCACAAGTAG

AGAATGGGCTTGTGTATCATCTTTTATTATATCAGGAACGACGGCGGCGACTCGTGCGAGT

GATATGGTTACGATCCCGACCGAAAACAACATTTATAACAGACCGCTTACTTGTTTGGTCGA

GGTTAACAGGAATTGGGGCGATATTCCTCCTAATGTAGCACCGCGTATTTTTGATTTTTCTGG

TGTGCCGCCTATTGAGTCAATCACATACGCTTTTAACACAACCGAGAAATATTACGGTCAGC

TTTATATGCAAACTTATAAAGCGTCGACAAGTAGTTACGTTTCTAGTTTGTTTACTGGTCGAA

CGGATGTTCGAAAACTCATTGGTGGTTTTAATATTTATTCTGATGGTACTAAACGAGTAGTTT

CTAACGGTGAGGCTACTAAAACCATGAAAACGGAATGGACGGGCGTAAAAACGCGGACCTT

TATTCGAATAGGAGGTCAAGCCACATCAGGGACACGTCATCTATTCGGCCATTTGAGAAATC

TTCGTCTCTGGCATAAAGAATTAACTGATGCGCAAATGGGGGAGAGTATTAAATGA

STF66 accessory protein
                                                      (SEQ ID NO: 213)
ATGAAAGATTTAACACTCAAATTTGCCGACAGGGCCGACTTTTCGGCCTTTATGGAGAGTAT

TGGCTATTATGATGACGAGTCGATGCAGGATGATATTCTTATTGACGTGATAGGTAACGTGT

ACAAAGAAACCGGAGAACTGACTGAAGATGGCGAACCGGTATGTGTTAAGGAAGACGGAT

ATTTTGTAAACGTGCGCATCATTAATGATTCGCAAATATCGTCATTATTCGATGAATACGTGG

TTGCTGTTGAGCATCAACTTCGTGGCTGGATGTGA gpJ VARIANT
1A2
                                                      (SEQ ID NO: 214)
MGKGSSKGHTPREAKDNLKSTQLLSVIDAISEGPIEGPVDGLKSVLLNSTPVLDTEGNTNISGVTV

VFRAGEQEQTPPEGFESSGSETVLGTEVKYDTPITRTITSANIDRLRFTFGVQALVETTSKGDRNPS

EVRLLVQIQRNGGWVTEKDITIKGKTTSQYLASVVMGNLPPRPFNIRMRRMTPDSTTDQLQNKT

LWSSYTEIIDVKQCYPNTALVGVQVDSEQFGSQQVSRNYHLRGRILQVPSNYNPQTRQYSGIWD

GTFKPAYSNNMAWCLWDMLTHPRYGMGKRLGAADVDKWALYVIGQYCDQSVPDGFGGTEPR

ITCNAYLTTQRKAWDVLSDFCSAMRCMPVWNGQTLTFVQDRPSDKTWTYNRSNVVMPDDGAP

FRYSFSALKDRHNAVEVNWIDPNNGWETATELVEDTQAIARYGRNVTKMDAFGCTSRGQAFIR

AGLWLIKTELLETQTVDFSVGAEGLRHVPGDVIEICDDDYAGISTGGRVLAVNSQTRTLTLDREIT

LPSSGTALISLVDGSGNPVSVEVQSVTDGVKVKVSRVPDGVAEYSVWELKLPTLRQRLFRCVSIR

ENDDGTYAITAVQHVPEKEAIVDNGAHFDGEQSGTVNGVTPPAVQHLTAEVTADSGEYQVLAR

WDTPKVVKGVSFLLRLTVTADDGSERLVSTARTTETTYRFTQLALGNYRLTVRAVNAWGQQGD

PASVSFRIAAPAAPSRIELTPGYFQITATPHLAVYDPTVQFEFWFSEKQIADIRQVETSTRYLGTAL

YWIAASINIKPGHDYYFYIRSVNTVGKSAFVEAVGRASDDAEGYLDFFKGKITESHLGKELLEKV

ELTEDNASRLEEFSKEWKDASDKWNAMWAVKIEQTKDGKHYVAGIGLSMEDTEEGKLSQFLV

AANRIAFIDPANGNETPMFVAQGNQIFMNDVFLKRLTAPTITSGGNPPAFSLTPDGKLTAKNADIS
```

-continued

```
GNVNANSGTLNNVTINENCRVLGKLSANQIEGDLVKTVGKAFPRDSRAPERWPSGTITVRVYDD

QPFDRQIVIPAVAFSGAKHEKEHTDIYSSCRLIVRKNGAEIYNRTALDNTLIYSGVIDMPAGHGHM

TLEFSVSAWLVNNWYPTASISDLLVVVMKKATAGITIS

STFs

WT STF accessory protein 1
                                                    (SEQ ID NO: 215)
MAFRMSEQPRTIKIYNLLAGTNEFIGEGDAYIPPHTGLPANSTDIAPPDIPAGFVAVFNS

DEASWHLVEDHRGKTVYDVASGDALFISELGPLPENFTWLSPGGEYQKWNGTAWVKDTEA

EKLFRIREAEETKKSLMQVASEHIAPLQDAADLEIATKEETSLLEAWKKYRVLLNRVDTS

TAPDIEWPAVPVME

SIED6
                                                    (SEQ ID NO: 216)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIADPASVPPLPDIW

LPLNDSLEAITGYAPGYKTITIGSDEITVPVNGICQFSRASSATYIDKSGHITVAGNNVP

RFEKYGLLIENQRTNMFVNSFNPDAWNKSGGISVTSSTDEFEFKYGRFTVGSDIAGTTTG

RNICTVAGNRGIDVTGDDQYSKGPYVTASFRVRSDLNVRARIRFERYNSEGYTFLCDAYL

SLQTHELQITGDNAQLLTANFEIDPGSGWIYFQATLKCLPEWGMVGTQLQIAADRAVGSF

ATGDWIEVTTPQFEYGACATSFIITTTEPATRASDLCKFPLMKNMYTMPFTFMVEVHKNW

FIAHNAAPRVIDTENHQSGAPFIMGFSSSGTISQDGYPYCDIGGANRRVYESCGVRDLVM

GFRVKADGMTCSFANKHISTETKTVWKYIREAAVIRIGGQTTTGLRHLNGHIKNLRFWNR

ALSDTQLKEYV

SIED6 accessory protein 1
                                                    (SEQ ID NO: 217)
MRDITLRFDNREQFNAIVYDSGLFSLEEENGILVDVIGRVIDYEEPENERCTGIDRGGFF

VNMRIVDSSKNISSLMPFITTDQHVRTWA

SIED6 accessory protein 2
                                                    (SEQ ID NO: 218)
MVTKTVIPDDIKTLKSDVSKLKNDQGSYATKSYVDSKDETVGDWSASWYQQVLPTSGAIF

GRKLRSTHRTAGVEDAYCELYLKKWIDSPGNAMARLNLNDNGENICWDFTNLYGGTMIFP

GTSGYLKMGNCLMSYGVRGSNALIKFDNTDSLQIKYANHGSTMTLNTQGTAYSGVSTLLW

GNSSRPVVYEIRDDGGLFLFYAQRNPDKTYQLEINGPCKATSFDQVSDRDLKENIRVIDN

ATERIRLMNGYTYRLKSNGMPYAGVIAQEALNAIPESVGSTIKYKSGDNGSDGE

SIEA11
                                                    (SEQ ID NO: 219)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT
```

-continued

```
AAAGSASTASTKATEAAGSAVSASQSKSAAEAAAIRAKNSAKRAEDIASAVALEDADTTR

KGIVQLSSATNSTSETLAATPKAVKAANDNANSRLAKNQNGADIQDKSAFLDNVGVTSLT

FMKNNGEMPVDADLNTFGSVKAYSGIWSKATSTNATLEKNFPEDNAVGVLEVFTGGNFAG

TQRYTTRDGNLYIRKLIGTWNGNDGPWGAWRHVQAVTRALSTTIDLNSLGGAEHLGLWRN

SSSAIASFERHYPEQGGDAQGILEIFEGGLYGRTQRYTTRNGTMYIRGLTAKWDAENPQW

EDWNQIGYQTSSTFYEDDLDDLMSPGIYSVTGKATHTPIQGQSGFLEVIRRKDGVYVLQR

YTTTGTSAATKDRLYERVFLGGSFNAWGEWRQIYNSNSLPLELGIGGAVAKLTSLDWQTY

DFVPGSLITVRLDNMTNIPDGMDWGVIDGNLINISVGPSDDSGSGRSMHVWRSTVSKANY

RFFMVRISGNPGSRTITTRRVPIIDEAQTWGAKQTFSAGLSGELSGNAATATKLKTARKI

NNVSFDGTSDINLTPKNIGAFASGKTGDTVANDKAVGWNWSSGAYNATIGGASTLILHFN

IGEGSCPAAQFRVNYKNGGIFYRSARDGYGFEADWSEFYTTTRKPTAGDVGALPLSGGQL

NGALGIGTSSALGGNSIVLGDNDTGFKQNGDGNLDVYANSVHVMRFVSGSVQSNKTINIT

GRVNPSDYGNFDSRYVRDVRLGTRVVQTMQKGVMYEKAGHVITGLGIVGEVDGDDPAVFR

PIQKYINGTWYNVAQV

SIEA11 accessory protein 1
                                                (SEQ ID NO: 220)
MQHLKNITAGNPKTVAQYQLTKNFDVIWLWSEEGKNWYEEVSNFQEDTIKIVYDENNIIV

GITRDASTLNPEGFSVVEVPDITANRRADDSGKWMFKDGAVIKRIYTADEQLQLAELQKS

ALLSEAETIIQPLERSVRLNMATDEERSRLEAWERYSVLVSRVDPANPEWPEMPQ

EB6
                                                (SEQ ID NO: 221)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKIAMDNANARLAKDRNGADIPNKPLFIQNLGLQETV

NKAGNAVQKTGDTLSGGLTFENDSILAWIRNTDWAKIGFKNDADSDTDSYMWFETGDNGN

EYFKWRSRQSTTTKDLMNLKWDALYVLVNAIVNGEVISKSANGLRIAYGNYGFFIRNDGS

NTYFMLTNSGDNMGTYNGLRPLWINNATGAVSMGRGLNVSGETLSDRFAINSSNGMWIQM

RDNNAIFGKNIVNTDSAQALLRQNHADRKFMIGGLGNKQFGIYMINNSRTANGTDGQAYM

DNNGNWLCGAQVIPGNYGNFDSRYVRDVRLGTRVVQLMARGGRYEKAGHAITGLRIIGEV

DGDDEAIFRPIQKYINGTWYNVAQV*

EB6 accessory protein 1
                                                (SEQ ID NO: 222)
MQHLKNIKSGNPKTKEQYQLTKNFDVIWLWSEDGKNWYEEVNNFQDDTIKIVYDENNIIV

AITKDASTLNPEGFSVVEIPDITANRRADDSGKWMFKDGAVVKRIYTADEQQQQAESQKA

ALLSEAENVIQPLERAVRLNMATDEERARLESWERYSVLVSRVDTAKPEWPQKPE*

AH11L
                                                (SEQ ID NO: 223)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV
```

-continued

```
ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKAANDNANSRLAKNQNGADIQDKSVFLDNVGVTSLT

FMKNNGEMPLDADLNTFGPVKAYLGIWSKATSTNATLEKNFPEDNAVGVLEVFAAGNFAG

TQRFTTRDGNVYMRKLANKWNGTDGPWGVWRHTQSATRPLSTTIDLNTLGAAEHLGLWRN

SSSAIASYERNYPEEGGFAQGTLEILEGGNYGRTQRYTTRRGNMYVRCLAASWDASNPQW

EPWLRVGHQSESRYYEGDLNDVTSPGIYSVTGKATNGPVLDGNGVTVLGILEVLRRFDGV

NVWQRYTTAGTGTTLKGRTFERVFTGSSWSEWREVYTSYSLPLNLGIGGAVAKLTSLDWQ

TYDFVPGSLITVRLDNMTNIPDGMDWGVIDGNLINIAVGPSDDSGTGRSMHVWRSTVSKA

NYRFFMVRISGNPGSRTITARRVPIIDEAQTWGAKQTFSAGLSGELSGNAATATKLKTAR

KINNVSFDGTSDINLTPKNIGAFASGKTGDTVANDKAVGWNWSSGAYNATTGGASTLILH

FNIGEGSCPAAQFRVNYKNGGIFYRSARDGYGFEADWSEFYTTTRKPTAGDVGALPLSGG

QLNGALGIGTSSALGGNSIVLGDNDTGFKQNGDGNLDVYANSVHIMRFVSGSIQSNKTIN

ITGRVNPSDYGNFDSRYVRDIRLGGAATYKPANNGMTWTHQAPSGCVYSGIIVQDTGSNS

ADNIGGVYYRPVQKYINGTWYNVAQV

AH11L accessory protein 1
                                                 (SEQ ID NO: 224)
MQHLKNITAGNPKTVEQYQLTKGFDVVWFFSEDGKNWYEEQKYFADDTIKIAYDKDNIIR

YVEKDVTAIRPDGLSVVEVADITANRRADISGGWMFKDGKVIKRIYTAEELLQQAENRKA

RLLADAESVILPLERAVRLNMATDEERSRLDAWERYSVLVSRVDPANPEWPEMPQ

WW55 3.0 accessory protein 1
                                                 (SEQ ID NO: 225)
MAISSGWVGSSAVSETGQRWMSAAMQAVRLGRPAYMSAMVGRSKEIHYSIGASNSYNKDT

LINWMKAQGSTPVVITITGNIVSQSTGVPCLDFPSSLTNEYVTLIINSGVHVLGRGGNGG

SNSAGGAGGNAINNGIGTRLRINNNGIIGGGGGGGAGARYNPFPQMDMKFGGGGGRPFGA

AGAAGGGAAAASAGTISAPGKGTVSGVHYGGDGGDLGAAGKSSYIKGGTGGTVHSGGAAG

KAVTGNAPRWDKVGTIYGARV

WW55 3.0 accessory protein 2
                                                 (SEQ ID NO: 226)
MSNQHEQMINVLKVRLFDTQEKAAFLEGQLKDRERVLMELVRILGIQPDENGTVSLDAIV

EEVKALLPKDEAAEDAEEEVELITEA

STF68B
                                                 (SEQ ID NO: 227)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAAASAT

ASANSQKAAKTSETNAKTSETAAANSAKASAASQTAAKASEDAAREYASQAAEPYKQVLQ

PLPDVWIPFNDSLEMITGFAPGYKKVTIGDDVITFPSEKVVSFTRSTSATYINKSGSFAF

AEINEPRFEKEGLLIEGQRTNTFTNSNNPSLWNYDDKNIEITTSVDEYGFKYGLFDVKET

STTERATIISTGYSRVIDVAANESVTLSCRVKKINGEGIITLRPRISFVNDDGTSNTLVA

GSYIDCETGDVLGFSGGDAVNHVIYREANGWLRVEFTYKSPEAKSMYGRFEMGADKRAIK

KGDQIMFTTPQFEKGSCASSFIVTSDVAVTRASDVVIMPIRLNWSTPPLSVLMEVNINWD
```

-continued

```
KMPNSEGSARLLNVSITGATTDVADESYMYFGFTSGGARSIITNGKGTKTEYKAYCNRTT

RRFIAGFKFTEQKELRAVINGNFGAVDVSQHTRQRYTEGPINIGGQSISGNRHLFGHVRN

LRIWHKELTDAQMGERI

STF68B accessory protein 1
                                                      (SEQ ID NO: 228)
MRDLTLKFINKADFSAFMDSIGYEDDEVMQNNVLIDVIGNVYKETGELTEDGEPVCVKED

GYFVNVRIINDAKKSSIFDKYAVVVEHQLRGWM

STF68B accessory protein 2
                                                      (SEQ ID NO: 229)
MATSTVIPDDIKTLKSDVSKLKNDQGSYATKSYVDSKDETVGDWSASWYQQVLPTSGAIF

GRKLRSTHRTAGVEDAYCELYLKKWIDSPGNAMARLNLNDNGTNICWDFTNLYGGTMIFP

GDSGYLKMGNCLMSYSKRGSNALIKFDYTDTLQIKYANHGSTMTLNTQGTAHAGVTTRLW

GNSSRPVVYEVGVDEALYMFYAQKTTSNTYELTVNGACNASAFNQGSDRDLKDNIQVIDN

ATDRIRKMNGYTYTLKENGMPYAGVIAQETLEAIPEAVGAMMKYPDGGSGLDGEEGERYY

TVDYSGVTGLLVQVARESDDRITALEEENAELRQRLSAIEAALASK

STF90B
                                                      (SEQ ID NO: 230)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKYTAQDATTARKGLVQLSSVTNSDSET

LAATPKAVKTAYDLANGKYTAQDATTARKGLVQLSSATNSDSETLAATPKAVKSAYDNAE

KRLQKDQNGADIPGKDTFTKNIGACRAYSGALSTDAGNWTTAQFIDWLESQGAFNHPYWM

CKCSWSYGNNKIITDTDCGTIHLAGCVIEVMGVKAAMTIRVTTPSTSSGGGTTSAQFTYI

NHGADYAPGWRRDYNTKNKQPAFALGKTGNTVANNKAVGWNWDSGAYCAQDGGASKMVL

HFYTGEGSCPAMQFLVDYKNRGIFYRSARDGYGFEADWSEFYTTSRKPTPADILALALSGG

SMSGSIKFINDAFLIWERNTDWAKIGFKNDSDADSDSYMWFETGDNGNEYFKWRIRSGST

TKDLMTLKSDALRVTGQVIPSNFSNFDSRYVRDIRLGGAATYKPANNGMTWTHQAPSGCV

YTGIIVQDTGSNSADNIGGVYYRPVQKYINGTWYNVAQV

STF90B accessory protein
                                                      (SEQ ID NO: 231)
MQHLKNITAGNPKTVEQYQLTKDFDVVWFFSEDGKNWYEEQKYFADDTIKIAYDKDNIIR

YVEKDVTAIRPDGLSVVEVADITANRRADISGNWMFKDGTVIKRIYTAEELQQQAENRKA

RLLADAESVILPLERAVRLNMATEEERSRLERWERYSVLVSRVDPANPEWPEMPQ

STF117
                                                      (SEQ ID NO: 232)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKYTAQDATTARKGLVQLSSATNSDSET
```

-continued

```
LAATPKAVKSAYDNAEKRLQKDQNGADIPGKDTFTKNIGACRAYSGALSTEAGNWTTAQF

IEWLDSRGAFNHPYWMCKGSWSYANNKIITDTGCGDIHLAGCVVEVMGTKSAITIRVTTP

TTSSGGGTTSAQFTYINHGDGYSPGWRRDWNRQGDAMTGTINQDGGSQNAYMSTALCSGT

RGGKKYLRKFRGGEGDTIWHETVQGGVVRWATGNTDAQEELSLSSAYGLRSRGEITSSSA

NGLRIAYGNYGFFIRNDGSSTYFMLTKSGDRLGTYNNLRPLIINDATGAVSMGHGLSVTG

DIASSTKVRAGSGKKFTVSSSNTSTKEAAFNLWGNSSRPVVAELGDDAGWHFYSQRNTDN

SITFAVNGQVSPSNYSNFDSRYVRDIRLGGAATYKPANNGMTWTHQAPSGCVYSGIIVQD

TGSNSADNIGGVYYRPVQKYINGTWYNVAQV

STF117 accessory protein 1
                                                    (SEQ ID NO: 233)
MQHLINITAGNPKTVEQYQLTKDFDVVWFFTEDGKNWYEEQKYFADDTIKIAYDKDNIIR

YVEKDVTAIRPDGLSVVEVADITANRRADISGNWMFKDGKVIKRIYTAEELQQQAENRKA

RLLADAESVILPLERAVRLNMATDEERSRLEAWERYSVLVSRVDPANPEWPEMPQ

O111
                                                    (SEQ ID NO: 234)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKAPLDSPALTGTPTAPTALRGTNNTQI

ANTAFVLAAIADVIDASPDALNTLNELAAALGNDPDFATTMTNALAGKQPKNATLTALAG

LSTAKNKLPYFAENDAASLTELTQVGRDILAKNSVADVLEYLGAGENSASGALQKNQNGA

DIPGKDTFTKNIGACRAYSAWLNIGGDSQVWTTAQFISWLESQGAFNHPYWMCKGSWAYA

NNKVITDTGCGNICLAGAVVEVIGTRGAMTIRVTTPSTSSGGGITNAQFTYINHGDAYAP

GWRRDYNTKNQQPAFALGQTGSRVANDKAVGWNWNSGVYNADISGASTLILFIFNMNAGSC

PAVQFRVNYRNGGIFYRSARDGYGFEANWSEFYITTRKPSAGDVGAYTQAECNSRFITGI

RLGGLSSVQTWNGPGWSDRSGYVVTGSVNGNRDELIDTTQARPIQYCINGTWYNAGSI

O111 accessory protein
                                                    (SEQ ID NO: 235)
MMHLKNITAGNPKTKEQYQLTKQFNIKWLYSEDGKNWYEEQKNFQPDTLKMVYDHNGVII

CIEKDVSAINPEGASVVELPDITANRRADISGKWMFKDGVVVKRTYTEEEQRQQAENEKQ

SLLQLVRDKTQLWDSQLRLGIISDENKQKLTEWMLFAQKVESTDTSSLPVTFPEQPE

DC1
                                                    (SEQ ID NO: 236)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKAAYDLANGKYTAQDATTARKGLVQLSSVTNSDSET

LAATPKAVKSAYDNAEKRLQKDQNGADIPGKDTFTKNIGACRAYSGALSTEAGNWTTAQF
```

-continued

IDWLESQGAFNHPYWMCKCSWSYGNNKIITDTDCGTIHLAGCVIEVMGVKAAMTIRVTTP

STSSSGGTTSAQFTYINHGADYAPGWRRDYNTKNKQPAFALGKTGNTVANNKAVGWNWDS

GAYCAQDGGASKMVLHFYTGEGSCPAMQFLVDYKNRGIFYRSARDGYGFEADWSEFYTTS

RKPTPADILALALSGGSMSGSIKFINDAFLIWERNTDWAKIGFKNDSDADSDSYMWFETG

DNGNEYFKWRIRSGSTTKDLMTLKSDALRVTGQVIPSNFSNFDSRYVRDIRLGGAATYKP

ANNGMTWTHQAPSGCVYTGIIVQDTGSNSADNIGGVYYRPVQKYINGTWYNVAQV

DC1 accessory protein 1

(SEQ ID NO: 237)

MQHLINITAGNPKTVEQYQLTKDFDVVWFFSEDGKNWYEEQKYFADDTIKIAYDKDNIIR

YVEKDVTAIRPDGLSVVEVPDITANRRADISGGWMFKDGKVIKRIYTAEELQQQAENRKA

RLLADAESVILPLERAVRLNMATDEERSRLDAWERYSVLVSRVDPANPEWPEMPQ

STF94A (SEQ ID NO: 238)

MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKYTAQDATTARKGLVQLSSAINSDSET

LAATPKAVKTAYDLANRKYTAQDATTARKGLVQLSSATNSDSETLAATSKAVKSAYDNAE

KRLQKDQNGADIPGKDTFTKNIGACRAYSGALSTEAGNWTTAQFIEWLDSRGAFNHPYWM

CKGSWSYANNKIITDTDGCGDIHLAGCVVEVMGTKSAITIRVTTPTTSSGGGTTSAQFTYI

NHGDGYSPGWRRDWNRQGDAMTGTINQDGGSQNAYMSTALCSGTRGGKKYLRKFRGGEGD

TIWHETVQGGVVRWATGNTDAQEELSLSSAYGLRSRGEITSLSANGLRIAYGNYGFFIRN

DGSSTYFMLTKSGDRLGTYNNLRPLIINDATGAVSMGHGLNVTGDIVSSTKVRAGSGKKF

TVSSSNTSTKEAAFNLWGNSSRPVVAELGDDAGWHFYSQRNTDNSITFAVNGQVSPSNYG

NFDSRYVRDIRLGGAATYKPANNGMTWTHQAPSGCVYSGIIVQDTGSNSADNIGGIYYRP

VQKYINGTWYNVAQV

STF94A accessory protein (SEQ ID NO: 239)

MQHLINIMAGNPKTVEQYQLTKGFDVVWFFTEDGKNWYEEQKYFADDTIKIAYDKDNIIR

YVEKDVTAIRPDGLSVVEVADITANRRADISGGWMFKDGKVIKRIYTAEELQQQAEIRKA

RLLADAESVILPLERAVRLNMATEEERTRLEAWERYSVLVSRVDPANPEWPEMPQ

STF69A (SEQ ID NO: 240)

ASATASANSQKAAKTSETNAKASETAAANSAKASAASQTAAKASEDAAREYASQAAEPYK

YVLQPLPEVWIPFNDSLDMITGFAPGYKSITVGDDVIALPSEKVVSFTRASTATYIDKSG

CFAESAINEPRFEKDGLLIEGQRTNTFSYTNTPVSWNYDTANLTITTGVDEYGFSYGLFG

VKETSTTERATLISTGYTRVISVSANESVTLSCRVKKVSGDGIITLRPRISYVNDDGSSN

TLTAGAYIDCETGDMLSYSGGEAATYNIFRESNGWIRVEFTYKSPEAKNMYGRFEFGAHQ

RSIKSGDKLMLTTPQFEKGLNASSFIITTEVGATRASDQVIIPIPFNWATPPVSVLMEVN

VNWDSEMPNLEGSARLLNISITGATTEVSDESYMYFGFTTRGKRLIITNGKGTKTEYKAY

GNREKRKFVTGFKFTEDKQLQVVVDGILGGSSPSLHTLQRYTAGNINIGGQSSSGNRHLF

GHVKNLRIWHKELTEAQMGESI

-continued

STF69A accessory protein 1
(SEQ ID NO: 241)
MKDLTLKFEDRADFSAFMESIGYYDDESMQDDILIDVIGNVYKETGELTEDGEPVCVKED

GYFVNVRIINDSQISSLFDEYVVAVEHQLRGWM

STF69A accessory protein 2
(SEQ ID NO: 242)
MATSTVIPDDIKTLKSDVSKLKNDQGSYATKLYVDSKDEIVGDWSASWYQQVLPTSGAIF

GRKLRSTHRTAGVEDAYCELYLKKWIDSPGNAMARLNLNDNGTNICWDFTNLYGGTMIFP

GDSGYLKMGNCLMSYSKRGSNALIKFDYTDTLQIKYANHGSTMTLNTQGTAYAGVTAQLW

GNSSRPVVYEVGVDGGAYMFYAQKNTDNTYMLSVNGACHATAFNQHSDRDLKDNIQVIDN

ATDRIRKMNGYTYTLKENGMPYAGVIAQEALEAIPEVVGSAMKYQDGASGSEGEEGERYY

TVDYSGVTGLLVQVARESDDRITALEEENAELRQRLSAIEAALASK

STF118
(SEQ ID NO: 243)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKAPLNSPALTGTPTTPTARQGTNNTQI

ANTAFVMAAIAALVDSSPDALNTLNELAAALGNDPNFATTMTNALAGKQPKDATLAALAG

LATAADRFPYFTGNDVASLATLTKVGRDILAKSTVSAVIEYLGLQETVNRAGNAVQKNGD

TLSGGLTFENDSILAWIRNTDWAKIGFKNDADGDTDSYMWFETGDNGNEYFKWRSRQSTT

TKDLMNLKWDALYVLVKALFSSEVKISTVNALRIFNSSFGAIFRRSEENLYIIPTRENEG

ENGDIGPLRPFGINLRTGVVSVGNGARIDGGLALGTNNALGGNSIVLGDNDTGFKQNGDG

NLDVYANNVHVMRFVSGSIQSNKTINITGRVNPSDYGNFDSRYVRDIRLGTRVVQTMQKG

VMYEKAGHVITGLGIVGEVDGDDPAVFRPIQKYINGTWYNVAQV

STF118 accessory protein
(SEQ ID NO: 244)
MQHLKNITAGNPKTVAQYQLTKNFDVIWLWSEEGKNWYEEVSNFQEDTIKIVYDENNIIV

GITRDASTLNPEGFSVVEVPDITSNRRADDSGKWMFKDGAVIKRIYTADEQEQQAESQKA

ALLSEAESVILPLERAVRLNMATDEERSRLEAWERYSVLVSRVDPANPEWPEMPQ

K1
(SEQ ID NO: 245)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAADAKT

AAAGSASTASTKATEAAGSAVSASQSKSAAEAAAIRAKNSAKRAEDIASAVALEDADTTR

KGIVQLSSATNSTSETLAATPKAVKVVMDETNRKAPLDSPALTGTPTAPTALRGTNNTQI

ANTAFVLAAIADVIDASPDALNTLNELAAALGNDPDFATTMTNALAGKQPKNATLTALAG

LSTAKNKLPYFAENDAASLTELTQVGRDILAKNSVADVLEYLGAGENSGAKGDGVTDDTA

ALTSALNDTPVGQKINGNGKTYKVTSLPDISRFINTRFVYERIPGQPLYYASEEFVQGEL

-continued

FKITDTPYYNAWPQDKAFVYENVIYAPYMGSDRHGVSRLHVSWVKSGDDGQTWSTPEWLT

DLHPDYPTVNYHCMSMGVCRNRLFAMIETRTLAKNALTNCALWDRPMSRSLHLTGGITKA

ANQRYATIHVPDHGLFVGDFVNFSNSAVTGVSGDMTVATVIDKDNFTVLTPNQQTSDLNN

AGKNWHMGTSFHKSPWRKTDLGLIPSVTEVHSFATIDNNGFAMGYHQGDVAPREVGLFYF

PDAFNSPSNYVRRQIPSEYEPDASEPCIKYYDGVLYLITRGTRGDRLGSSLHRSRDIGQT

WESLRFPHNVHHTTLPFAKVGDDLIMFGSERAENEWEAGAPDDRYKASYPRTFYARLNVN

NWNADDIEWVNITDQIYQGGIVNSGVGVGSVVVKDNYIYYMFGGEDHFNPWTYGDNSAKD

PFKSDGHPSDLYCYKMKIGPDNRVSRDFRYGAVPNRAVPVFFDTNGVRTVPAPMEFTGDL

GLGHVTIRASTSSNIRSEVLMEGEYGFIGKSIPTDNPAGQRIIFCGGEGTSSTTGAQITL

YGANNTDSRRIVYNGDEHLFQSADVKPYNDNVTALGGPSNRFTTAYLGSNPIVTSNGERK

TEPVVFDDAFLDAWGDVHYIMYQWLDAVQLKGNDARIHFGVIAQQIRDVFIAHGLMDENS

TNCRYAVLCYDKYPRMTDTVFSHNEIVEHTDEEGNVTTTEEPVYTEVVIHEEGEEWGVRP

DGIFFAEAAYQRRKLERIEARLSALEQK

STF66
(SEQ ID NO: 246)
MAVKISGVLKDGTGKPVQNCTIQLKARRNSTTVVVNTVGSENPDEAGRYSMDVEYGQYSV

ILQVDGFPPSHAGTITVYEDSQPGTLNDFLCAMTEDDARPEVLRRLELMVEEVARNASVV

AQSTADAKKSAGDASASAAQVAALVTDATDSARAASTSAGQAASSAQEASSGAEAASAKA

TEAEKSAAAAESSKNAAATSAGAAKTSETNAAASQQSAATSASTAATKASEAATSARDAV

ASKEAAKSSETNASSSAGRAASSATAAENSARAAKTSETNARSSETAAERSASAAAASAT

AAANSQKAAKTSETNSKASETAAANSAKASAASQTAAKASEDAAREYASQAAEPYKQVLQ

PLPDVWIPFNDSLDMITGFSPSYKKIVIGDDEITMPGDKVVKFKRASKATYINKSGVLTE

AAIDEPRFERDGLLIEGQRTNYMLNSENPASWGRSSNMDVPETGTDSFGFTYGKFVCNDS

LIGQTSAINMASIAATKSVDVSGDNKYVTTSCRFKTELQVRLRIRFDKYDGSATTFLGDA

YIDTQTLEINMTGGASGRITARVRKDETTGWIFAEATIQAIDGELKIGSQIQYSPKQGGA

TVSGDYIYLATPQVENGACVSSFIISGTTAATRASDMVTIPTENNIYNRPLTCLVEVNRN

WGDIPPNVAPRIFDFSGVPPIESITYAFNITEKYYGQLYMQTYKASTSSYVSSLFTGRTD

VRKLIGGFNIYSDGTKRVVSNGEATKTMKTEWTGVKTRTFIRIGGQATSGTRHLFGHLRN

LRLWHKELTDAQMGESIK

STF66 accessory protein
(SEQ ID NO: 247)
MKDLTLKFADRADFSAFMESIGYYDDESMQDDILIDVIGNVYKETGELTEDGEPVCVKED

GYFVNVRIINDSQISSLFDEYVVAVEHQLRGWM

SEQUENCE LISTING (263 sequences)

SEQ ID NO: 1 - protein, 774 aa, Artificial Sequence
  Synthetic: lambda stf
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSAFPAGAPIPWPSDIVPSGYVLMQGQAFDKSAYPKLAVAYPSGVLPDMRGWTIKGKPASGRAVLSQEQDGIKSHTHSASASGTDLGTKTTSSFDYGTKTTGSFDYGTKSTNNTGAHAHSLSGSTGAAGAHAHTSGLRMNSSGWSQYGTATITGSLSTVKGTSTQGIAYLSKTDSQGSHSHSLSGTAVSAGAHAHTVGIGAHQHPVVIGAHAHSFSIGSHGHTITVNAAGNAENTVKNIAFNYIVRLA

SEQ ID NO: 2 - protein, 686 aa, Artificial Sequence
  Synthetic: STF-25
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSRNAAKTSETNAGNSAKAAASSKTAAQNAATAAERSETNARASEEASADSEEASRRNAESAAENAGVATTKAREAAADATKAGQKKDEALSAATRAEKAADRAEAAAEVTAEPCANIVPPLPDVWIPFNDSLDMIAGFSPGYKKIAIGDDVVQVASDKQVNFSRASTATYINKSGELKTAEINEPRFECDGLLIEGQRTNYMLNSESPASWGKSSNMDVPETGTDSFGFTYGKFVCNDSLVGQTSAINMASIAATKSVDVSGDNKYVTTSCRFKTERQVRLRIRFDKYDGSATTFLGDAYIDTQTLEISMTGGAAGRITARVRKDKTTGWIFAEATIQAIDGELKIGSQIQYSPGQGGATVSGDYIYLATPQVENGPCVSSFIISGGSATTRASDLVSIPTRNNLYKLPFTFLLEIHKNWDIAPNAAPRVWDIAAANTGQSAIAAINRGSGKLYMSLSNPSGSYVNSAATDVFAEKTTFGCIAKADGHFHVVTNGKAVNEVYCEYNGVTADKNIRFGGQTNTGERHLFGHIRNFRIWHKELNDRQLKEVV

SEQ ID NO: 3 - protein, 92 aa, Artificial Sequence
  Synthetic: STF25-AP1
MKDLTLKFHDKLQFKAFLSSLGWAEDEDLQNKLLVDEIGFTYTETGVTEEGEPVCIRNDGYFVNIRILDDLFDVSVFSDYVVELETPLREWS

SEQ ID NO: 4 - protein, 687 aa, Artificial Sequence
  Synthetic: STF-27
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSKNAAKTSETNAANSAQAAAASQTASANSATAAKKSETSAKNSETATKASEKNAKSSQTAAKTSETNAKDSEANAKVSETAAANSAKASAASQTAAKASEDAAREYANQTAEPYRYVLQPLPDVWIPFNDSLDMITGYSPGYKKVKIGDNVVQVASDKQVNFSRASTATYINKSGELKTAEINEPRFECDGLLIEGQRTNFFQNSTDPSKWNKSTSLDVTETGTDSFGFNYGRFVVQDSIVGTSKAHTIIGLYSSTGGVDTSGDEKHVTISCRVKSEVDNIAVRILFEHYDGEVRTSIGAANLNLTTRIISKTGQTSRVTARSVKDDATGWIFFEATLKADTTENTVGGFVQYSPDTGQMVTSGDYLDVTTPQIEAGTGASSFIVTGTAPATRASDMVTVPIKNNLYNLPFTVLCEVHKNWYKTPNVAPRVFDTGGHQTGAGIVMGFGSSGGYDGFPYCDIGGSDRRINENAGLEKMLIGMRVKSERSTCVVSNGKLSSETKTKWEYIRSTATIRIGGQTTAGLRHLFGHVRNFRLWHKELTDAQLGEVVE

SEQ ID NO: 5 - protein, 92 aa, Artificial Sequence
  Synthetic: STF27-AP1
VRDFTLRFSDKADFRAFLRKLNWEEDEELQNAVLVDEIGFTFRETDVSDDGEPEYTRNEGYFVNIRLLDDGFEDSVFREWVVTPERPLREWF

SEQ ID NO: 6 - protein, 88 aa, Artificial Sequence
  Synthetic: STF27-AP2
MLPQHSDIEIAWYASIQQEPNGWKTVTTQFYIQEFSEYIAPLQDAVDLEIATEEERSLLEAWNKYRVLLNRVDTSTAPDIEWPTSPAE

SEQ ID NO: 7 - protein, 673 aa, Artificial Sequence
  Synthetic: >STF-28
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSETAAASSRNAAKTSETNAGNSAKAAASSKTAAQNAATAAERSETNARASEEASADSEEASRRNAESAAENAGVATTKAREAAADATKAGQKKDEALSAATRAEKAADRAESAAEVTAEPCANIVPPLPDVWIPFNDSLDMITGFSPSYKKIVIGDDEITMPGDKIVKFKRASTATYINKSGQLKLAEVDEPRFERDGLLIEGQRTNYLRNSNKPDSWTVHSALNKTFGTDKQGFNYATVTPTESIVGTTGGYTVHGVVAADRFPLASGECFTFSCRVKGAKARCRLRVSVIIGGTDTFSADSYLDLDTRIATVSGNTSLITAKAEQQGEWTYYEATYTANTDIDTVNCAFYMTNKISNEPFYDDSTLTMTTPQIELGNTASSFIVTTMPTTRASDVVTIPSANNLSTRPFTVLCEVRRNWSTPPNVAPRIFDVGGHSIDDNYLSLGFVSTGKISANVGMVQPQISSDGERFIVGVRAKSDLSVNAICNGNYTTNLNGKIFGVTATSYRFGGQTAAGTRHLFGHIRNFRVWFKELNDRQIKEAV

SEQ ID NO: 8 - protein, 92 aa, Artificial Sequence
  Synthetic: STF28-AP1
MKDLTLKFPGNREFKSFLSSLDWEEDEDLQNKLLVDEIGFTYTETGVTEEGEPVCIRNNGYFVNIRILDDLFDVSVFSDYVVELETPLREWS

SEQ ID NO: 9 - protein, 798 aa, Artificial Sequence
  Synthetic: STF-15
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKVSETAAANSAKASAASQTAAKASEDAAREYASQAAEPYKYVLQPLPDVWIPFNDSLDMITGFSPSYKKIVIGDDEITMPGDKVVKFKRASTATYINKSGVFSVAKIDEPRFEKEGLLIEGQRTNYFVKSNTPAEWTSTSNIDKTNNGVDEFGFSYAKMRTKDNMTGQSSALSLHRCSASRGIDVSGDNKYCTVSCRVKAPDGLRCRLRFEKYDGSVYTFLGDAYLTFGTLIIEKTGGAANRIAATATKDPVTGWIFYEATIEAVEGETLIGAMIQYAPKKGGITEAGDYIYLATPQFENGGCASSFVITTTAPATRSSDMVTIPTKNNIYNRPLTCLVEVNRIWGDIPPNVAPRIFDFSGVPPIESITYAFNTTEKYYGQLYMQTYKASTSTYVSSVFAGRADVRKFIGGFNIYSDGTKRVVSNGEATKTMKTEWTGVKTRTFIRIGGQATSGTRHLFGHLRNLRLWHKELTDAQMGESIK

SEQ ID NO: 10 - protein, 93 aa, Artificial Sequence
  Synthetic: STF15-AP1
MKDLTLKFADRADFSAFMESIGYYDDESMQDDILIDVIGNVYKETGELTEDGEPACVKEDGYFVNVRIINDSQISSLFDEHAVAVEHQLRSWM

SEQ ID NO: 11 - protein, 234 aa, Artificial Sequence
  Synthetic: STF15-AP2
MATSTVIPDDIKTLKGDVSKAKEDISSINVKVSTLQTDMDSAKQDISTRYTKTEVDNKLKNKVEVNDLESGRYGGDFYPLTGREAFYLWGLGTTTAAANLYLNPDPAISSVLRSTSSIRYKHSVETIDSEHADLIFRMRPVWYRSQCENDRRDWGFYGLIAEEVGEIAPQFVHWRPANEDDAPETISSNGLVAEGVMYERLVVPLIHHIQKLTERVDELESELKLLSTSQSDIG

SEQ ID NO: 12 - protein, 791 aa, Artificial Sequence
  Synthetic: STF-16
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAKASAASQTAAKASEDAAREYASQAADPYKYVLQPLPDVWIPFNDSLDMITGFSPSYKKIVIGDDEITMPGDKIVKFKRASKATYINKSGVLTEAAIDEPRFERDGLLIEGQRTNLLLNSTNPSKWNKSGNLELTEISTDSFNFTYGRFTVKDTLIGQTSAINIVTISGSKGFDVTGDEKYVTISCRVRSDVENIRCRLRFEHHDGYTYTFLGDAYLNLSTLVIDKTGTAADRIIAKAVKDEVTGWIFYQATINALDTESMIGAMVQYAPVKGSGTASGDYLDIATPQVEGGSSASSFIVTDITASTRASDMVTVPIKNNLYNLPFTVLCEVHKNWYKTPNAAPRVFDTGGHQTGAAIILGFGRSTDYDGFPYCDIGLANRRVNENASLEKMVMGMRVKSDQSTCSVSNGRISSEKKATWSYIQNSAIIRIGGQTTAGLRHLFGHVRNFRIWHKALTDAQMGESI

SEQ ID NO: 13 - protein, 93 aa, Artificial Sequence
  Synthetic: STF16-AP1
MKDLTLKFADRADFSAFMDSIGYYDDESMQDDILIDVIGNVYKETGELTEDGEPVCVKEDGYYVNVRIINDAKKSSIFDEYAVVVEHQLRGWM

SEQ ID NO: 14 - protein, 234 aa, Artificial Sequence
  Synthetic: STF16-AP2
MATSTVIPGDITTLKGDVSKAKEDISSINGKVSTLQADMTSAKQDISTRYTKTEVDNKLKNKLEVNALESGRYGGDFYPLTGREAFYLWGLGTTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLSVSRSDIG

SEQ ID NO: 15 - protein, 941 aa, Artificial Sequence
  Synthetic: STF-17
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAGSKTAAALSASAASTSAGQASASATAAGKSAESAASSASTATTKAGKATEQATAAARSASAAKTSETNAKTSADNAASSKAAAASSASSAASSASSASASKDEATRQASAAKGSATTASTKATEAAGSATAAAQSKSTAESAATRAETAAKRAEDIASAVALEDASTTKKGIVQLSSATNSTSESLAATPKAVKAVMGETNKKAPLNSPALTGTPTTPTARQGTNNTQIASTAYVMAAIAALVDSSPDALNTLNELAAALGNDPNFATTMTSALAGKQPKDATLTALAGLATAADRFPYFTGNDVASLATLTKVGRDILAKSTVAAVIEYLGLRELGTSGEKIPLLSTANTWTNRQTFSGGLSGELSGNASTAAKLKTARKISNVAFDGSSDITLKASHVGAFALGKTGSTVANDKAVGWNWSSGAYNATISGASTLIIHFYMGEGSCPAAQFRINYKNGGIFYRSARDGYGFEADWSEFYTTTRKPSAGDVGALPLSGGQLNGALGIGTSSALGGNSIVLGDNDTGFKQNGDGNLDVYANNVHVMRFVSGSIQSNKTINITGRVNPSDYGNFDSRYVKDVRLGSQQYYGVNNWQTWNFQCPSGHVLSGINVQDTGSNSADNIAGVYYRPVQKYINGTWYNVASV

SEQ ID NO: 16 - protein, 177 aa, Artificial Sequence
  Synthetic: STF17-AP1
MMHLKNIKAGNAKTLEQYELTKKHGVIWLYSEDGKNWYEEVKNFQPDTIKIVYDENNIIVAITKDASTLNPEGYSVVEIPDITANRRADDSGKWMFKDGAVIKRVYTEEELRLQTENQKKILLQQAREKTQFWQTQLTLGIITDSDRQQLMNWMRYVQQVETTDTSVLPVTFPEPPE

SEQ ID NO: 17 - protein, 791 aa, Artificial Sequence
  Synthetic: STF-13
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAASSATASANSQKAAKTSETNAKASETAAANSAKASAASQTAAKASEDAAREYASQAAEPYKQVLQPLPDVWIPFNDSLDMLAGFSPGYKQITVGDDVIKMPSDKVVSFKRASGATYINKSGVLTVAEVDEPRFEREGLLIEGQRTNYHLNSLTPSKWGATTSVTITESGVDEFGFTYGRFQIKDEKIGTNTTMNIAAVSGGRGVDVTGTEKYVTTSCRVKSDSANIQCRIRFERYDGSAYFYLADAYLNITDMSIRKTGGGAARITARAEKESNGWIYFEVTYQSEAIDNMVGSQIQIAPPVSPGTYLGGEYLDVTTPQFEGGSCASSFIISDTVASTRASDIVTLPCKNNMASKPLTCMVEVNKNWSIAPNSAPRIYDITGFKTKDDAFVFAFRNTAGSVGTPYVQFGNPISFPPGNYPRKIIAVYRIKSDGKFQAGCNGVLSTPASTTWKSVSGATGIRIGGQTTAGLRHLFGYIRNFRIWHKELTDAQMGEII

SEQ ID NO: 18 - protein, 93 aa, Artificial Sequence
  Synthetic: STF13-AP1
MRDLIIKFTDKADFSAFMKSAGYYDDESMQDDILIDVIGNVYKETGELTEDGEPVCVKEDGYFVNVRIINDAKKSSIFDKYAVVVEHQLRGWM

SEQ ID NO: 19 - protein, 234 aa, Artificial Sequence
  Synthetic: STF13-AP2
MATSTVIPGDITKLKGDVSKAKEDISSISRKVSTLQTEMTSAKQDISSRYTKTEVDNKLKNKVEVNDLESGRYGGDFYPLTGREAFYLWNLATTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLLTSRSDIR

SEQ ID NO: 20 - protein, 781 aa, Artificial Sequence
  Synthetic: STF-12
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAQASAASQTAAKASEDAAREYASQAAEPYKYVLQPLPDVWIPFNDSLDMLAGFSPGYKQITVGDDVIKMPSDKVVSFKRASGATYINKSGVLTVAEVDEPRFEREGLLIEGQRTNYFRNSNTPEAWNNTGSVSVESFDSDKGFNYGRITVINENPTAQGYQAIAVNTNDAYTCPAGSYTTISCLTKSDNSRCRARFGKMSDNGAFVFHSDAVLDPVTGNVVHGNNVTVTAERVGEWWLFTATLFADAEMIISSRFEILAMPGISIIPNGSTLDIAMPQAEIGSYRTSFIITEGAPGTRSSDMVTIPVRNNIHRLPFSALVEVNKNWDIPPSKSPLIFNVKDYQENGLFTHGFRGNNFSDAGSPFISMGGCNKYVATTQRKIISGFRCGADGDVQAVCNGELSVAAKTTWTSIVPRAVLRIGGQGTNGEYHLFGHIRNLRIWHKELTDAQMGESIK

SEQ ID NO: 21 - protein, 93 aa, Artificial Sequence
  Synthetic: STF12-AP1
MKDLTLKFADRADFSAFMESIGYYDDESMQDDILIDVIGNVYKETGELTEDGEPVCVKEDGYFVNVRIINDVKKSSIFDKYAVVVEHQLRGWM

SEQ ID NO: 22 - protein, 234 aa, Artificial Sequence
  Synthetic: STF12-AP2
MATSTVIPGDITTLKGDVSKTKEDISSINGKVSTLQTDMTSAKQDISTRYTKTEVDNKLKNKLEVNDLESGRYGGDFYPLTGREAFYMWGLGTTTAAANLYLNPDPAISSVLRSTSSIRYKHSVETIDSEHADLIFRMRPVWYRSQCENDRRDWGFYGLIAEEVGEIAPQFVHWRPANEDDAPEAISSNGLVAEGVMYERLVVPLIHHIQKLTERVDELESELKLLSVSRSDIG

SEQ ID NO: 23 - protein, 702 aa, Artificial Sequence
  Synthetic: STF-63
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAANSATAAKKSETNAKNSESAAKVSETNAKASENKAKEYLDKVGGLVSPMTQYDWPVVTGNESFYIKIAKLSDPGSNNCHVTLMVTNGGDYGSPYGNIDFIEISARGLPSSLTADNVSRYLSIRRLGPTGLINSMQMRYGLVKDDGFIEVWAFQRAFINGAKVAVLAQTARTELYIPDGFVKQTAAPSGYVESPVVRIYDQLNKPTKADLGLSNAMLTGAFGLGGSGISTNGKMSDVEILKALRDKGGHFWRGDKPTGSTATIYSHGSGIFSRCGDTWSAINIDYSTAKIKIYAGNDARLNNGTFSINELYGSANKPSKSDVGLGNVTNDAQVKKTGDTMTGDLTIKKGTPSVFLRADSGVTALRFYTGDNTERGIIYAGPNTDSLGEVRIRAKTAGGTSGGDLVVRH

SEQ ID NO: 24 - protein, 1253 aa, Artificial Sequence
  Synthetic: STF-62
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAANSATAAKKSETNAKNSEAAAKVSETNAKASENKAKEYLDKVGGLVSPMTQYDWPVVTASESLYIKIAKLSDPGTSRSHVTLMVTNAGNYGSPYGNIDFIEISARGLPSLLSADNVSRHLSIRRLGSTGLTDNNQMRYGLVKGDGFIEVWAFQGAFINDAKVAVLAQTTLNTELYIPDGFVKQTAAPSGYIEGNVVRIYDQVNKPTKADLGLSNAMLTGAFGLGGSGISTNGKMSDVEILKALRDKGGHFWRGDKPTGSTATIYSHGSGIFSRCGDTWSAINIDYSTAKIKIYAGNDARLNNGTFSVNELYGSANKPSKSDVGLGNVTNDAQVKKSGDVMSGDLDILKETPSIRLKSAKGTAHLWFMNNDGSERGVVWSPENNESLGEIHIRAKNTKGESSGDFIVRHDGRVEARNLKITYKISAATAEFANTSTSSDNTTVSIKGSQHTPLVLTSNNTIKNLSIGFKVDDVDQKYLGIAGDGDLYFGSYSDHTKNSKVITQAKLDSGVTVGGKTTFSDLATFNAGMAGSIEPETIDNKTIDLNDLIIANTVAGSVKYYQCKTVAGGAYITNKPDGVSGNFLLRVESTRKTTGSDYAIMQTLIGSDTKRIYVRFVVNGSWTEWSQVVVSGWNQDVTVRSLTSTTPSKLGGGRVDVLGSTSDYSSMNCAVRGVDSTGTNSAWSVGTSKNTGKMLCLKNHRSSAQVLLNGDDGAVQLLSGTVNGATAQALTINKDEVNSTADLVIRKQTGTGNRFALLNSGNSELPVGIRVWGSSTRQNVFEVGTSTAYLFYAQKTSAGQLFDVNGAINCTTLNQSSDRDLKDDILVISDATKAIRKMNGYTYTLRENGMPYAGVIAQEVMEAIPEAVGSFTHYGEELQGPTVDGNELREETRYLNVDYAAVTGLLVQFARETDDRVTALEEENTTLRQNLATADTRISTLENQVSELVALVRQLTGSEH

SEQ ID NO: 25 - protein, 790 aa, Artificial Sequence
  Synthetic: STF-71
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAASSATASANSQKAAKTSETNAKASETAAANSAKASAASQTAAKASEDAAREYASQAAEPYKQVLQPLPDVWIPFNDSLDMITGFSPSYKKIVIGDDEITMSGDKVVKFKRASKATYINKSGVLTEAAIDEPRFERDGLLIEGQRTNYMLNSESPASWGRSSNMDVPETGTDNFGFTYGKFVCNDSLIGQTSAINMASIAATKSVDVSGDNKHVTTSCRFKTELQVRLRIRFDKYDGSATTFLGDAYIDTQTLEINMTGGAASRITARVRKDEATGWIFAEATIQAIDGELKIGSQIQYSPKQGGATVSGDYIYLATPQVENGPCVSSFIISGTTAATRASDIVTVPIKNNLYNLPFTVLCEVHKNWYKTPNAAPRVFDTGGHQTGAAIILGFGSSADYDGFPYCDIGGANRRVNENALLEKMVMGMRVKSDQSTCSVSNGRISSETKTTWSYIQNTAIIRIGGQTTAGLRHLFGHVRNFRIWHKALTDAQVGESI

SEQ ID NO: 26 - protein, 93 aa, Artificial Sequence
  Synthetic: STF71-AP1
MKDLTLKLADRADFSAFMESTGYYDDESMQDDILIDVIGNVYKETGELNEDGEPVCVKEDGYFVNVRIINDVKTPSIFDEYVVAVEHQLRGWM

SEQ ID NO: 27 - protein, 1098 aa, Artificial Sequence
  Synthetic: STF-20
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRLAKNQNGADIQDKSAFLDNIGVTSLTFMKNNGEMPVDADLNTFGPVKAYVGVWYKSTSSNATLEKNFPEDGAVGVLEVFNGGNFSGMQRYTTRTGNVYMRNLSGTWNGSDGPWIYWRQIQSATRPLSTTIDLNTLGGAEHLGLWRNSSGSIASFDRNYPEEGSYGQGFLEVLEGGGYSRTQRYTTRRGNVYVRCLSAIWNAQNPQWEPWSRVGHQSECRYYEGDLNDLTSPGIYSVTGKASNGPMQDTAGATLLGILEVIRRFDGVSVWQRYTTTGKSETTQGRTFERVYAGSKWTEWREVYNSFSLPLNLGIGGAVAKLSSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 28 - protein, 175 aa, Artificial Sequence
  Synthetic: STF20-AP1
MQHLKNITAGNPKTVAQYQLTKNFDVIWLWSEEGKNWYEEVSNFQEDTIKIVYDENNIIVGITRDASTLNPEGFSVVEVPDITANRRADDSGKWMFKDGAVIKRIYTADEQLQLAELQKSALLSEAETIIQPLERSVRLNMATDDERSRLEAWERYSVLVSRVDPANPEWPEMPQ

SEQ ID NO: 29 - protein, 757 aa, Artificial Sequence
  Synthetic: STF-23
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTARQGTNNTQIASTAFVMAAIAALVDSSPDALNTLNELAAALGNDPNFATTMTNALAGKQPKDATLTALAGLATAADRFPYFTGNDVASLATLTKVGRDILAKSTVAAVIEYLGLRELGTSGEKIPLLSTANTWTNRQTFSGGLSGGLSGNAATATKLKTARKIAGVGFDGSSDISISAKNVNAFALRQTGNTVNGDTSVGWNWDSGAYNALIGGASALILHFNINAGSCPAVQFRVNYKNGGISYRSARDGYGFELGWSDFYTTTRKPSAGDVGAYTRAECNSRFITGIRLGGLSSVQTWNGPGWSDRSGYVVTGSVNGNRDELIDTTQARPIQYCINGTWYNAGSI

SEQ ID NO: 30 - protein, 177 aa, Artificial Sequence
  Synthetic: STF23-AP1
MMHLKNITAGNPKTKEQYQLTKQFNIKWLYSDDGKNWYEEQKNFQPDTLKMVYDHNGVIICIEKDVSAINPEGASVVELPDITANRRADISGKWLFKDGVVIKRTYTEEEQRQQAENEKQSLLQLVRDKTQLWDSQLRLGIISDENKQKLTEWMLYAQKVESTDTSSLPVTFPEQPE

SEQ ID NO: 31 - protein, 712 aa, Artificial Sequence
  Synthetic: STF-24
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRLQKDQNGADIPDKRLFLRNIGATNSTTMSFSGGTGWFRLATVTMPQASSVVYISLIGGAGYNVNSPMQAGISELVLRAGNGNPKGLTGALWRRTSVGFTNFAWVNTSGDTYDVYVEIGNYATGVNIQWDYTSNASVTIHTSPTYTANKPTGLTDGTVYVIYSSYIKPTAADVGALSLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 32 - protein, 175 aa, Artificial Sequence
  Synthetic: STF24-AP1
MQHLKNITAGNPKTVAQYQLTKNFDVIWLWSEEGKNWYEEVSNFQEDTIKIVYDENNIIVGITRDASTLNPEGFSVVEVPDITANRRADDSGKWMFKDGAVIKRIYTADEQLQLAELQKSALLSEAETIIQPLERSVRLNMATDEERSRLEAWERYSVLVSRVDPANPEWPEMPQ

SEQ ID NO: 33 - protein, 840 aa, Artificial Sequence
  Synthetic: O111-2.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTAPQGTNSTQIASTAFVMAAIAALVDSSPDALNTLSELAAALGNDPNFATTMTNALAGKQPKDATLTALAGLVTAADRFPYFTGNDVASLATLTEVGRDILAKSTVAAVIEYLGLQETVNQASGALQKNQNGADIPGKDTFTKNIGACRAYSAWLNIGGDSQVWTTAQFISWLESQGAFNHPYWMCKGSWAYANNKVITDTGCGNICLAGAVVEVIGTRGAMTIRVTTPSTSSGGGITNAQFTYINHGDAYAPGWRRDYNTKNQQPAFALGQTGSRVANDKAVGWNWNSGVYNADISGASTLILHFNMNAGSCPAVQFRVNYRNGGIFYRSARDGYGFEANWSEFYTTTRKPSAGDVGAYTQAECNSRFITGIRLGGLSSVQTWNGPGWSDRSGYVVTGSVNGNRDELIDTTQARPIQYCINGTWYNAGSI

SEQ ID NO: 34 - protein, 177 aa, Artificial Sequence
  Synthetic: O111 2.0-AP1
MMHLKNITAGNPKTKEQYQLTKQFNIKWLYSEDGKNWYEEQKNFQPDTLKMVYDHNGVIICIEKDVSAINPEGASVVELPDITANRRADISGKWMFKDGVVVKRTYTEEEQRQQAENEKQSLLQLVRDKTQLWDSQLRLGIISDENKQKLTEWMLFAQKVESTDTSSLPVTFPEQPE

SEQ ID NO: 35 - protein, 754 aa, Artificial Sequence
  Synthetic: STF-74
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDASTAQKGLVKLSSATDSTSETLAATPKAVKAVNDNANGRVPSERKVNGHSLAGDISVTSQDIFDGQCVEIGPGQDLDNYQTPGLYFQPANANTSAALHYPENNAGSLMVLRSAGITQVYRVYSGSRSYLRSKYSTQPWTTWTPDDAFPVGAPIPWPSDIAPPAYALMQGQSFDKSAYPLLAVAYPSGVIPDMRGQTIKGKPDGRAVLSYEQDGIKSHAHTASISDTDLGTKYTNSFDYGSKPTTSFDYGNKSSTEGGWHVHNFRYCATSAYRDTPGSGLGMHSSNISWSAGDRIEGSGNHAHVTWIGPHDHWVGIGEHNHYVVMGYHGHTATVHATGNTENTVKNIAFNYIVRLA

SEQ ID NO: 36 - protein, 192 aa, Artificial Sequence
  Synthetic: STF74-AP1
MAFEMTGENRTIILYNLRSDTNEFIGKSDGFIPANTGLPAYSTDIAPPKVTAGFVAVFDAQTNKWSRVEDYRGTTVYDISTGKPAVIEKLGALPDNVVSVAPDGEYVKWDGAKWIHDAEAEKTFRQGQAAQEKSNLLMIATSAIAPLQDAVDLDMATEDEATALNEWKKYRVMLNRVKPEDAPDITWPELPA

SEQ ID NO: 37 - protein, 710 aa, Artificial Sequence
  Synthetic: STF-86
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPASRKVNGHALNGDINVTSRDIFDGQVIAIGANKNLDDYQVPGLYFQEANNNTSAAMNYPENSAGSLMVLRGAGVTQVYRVYNSSRSYSRSKYSTLAWTPWMPEDSYPVGAPIPWPSDVTPTGYALMQGQPFDKAVYPLLAIAYPAGIIPDMRGQTIKGKPNGRAVLSYEQDGVISHTHGASISDTDLGTKYTSSFDYGSKPTTSFDYGNKSSTEGGWHAHNFRYCATSAYRDTPGQGLGMHSSNVSWAAGDRIEGSGNHAHVTWIGPHDHWVGIGAHNHYVVMGYHGHTATVHAAGNAENTVKNIAFNYIVRLA

SEQ ID NO: 38 - protein, 195 aa, Artificial Sequence
  Synthetic: STF86-AP1
MTFEMTGENRTITIYNLRADTNEFIGKSDGFIPANTGLPANSTNIAPPPMKAGFVAVFNSASEKWSLVEDHRGKIVYDILTGKSITIDELGQLPDDVVSVAPEGHFVKWNGKKWVHDADAEKTAQITQATQQKDSLLALAASKIAPLQDAVDLDIATEEETALLLAWKKYRVLINRIKPEDAPDIDWPEVPGDVA

SEQ ID NO: 39 - protein, 863 aa, Artificial Sequence
  Synthetic: STF-84
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTAQKGIVQLSNATNSTSEMLAATPKSVKAAYDLANGKYTAQDATTAQKGIVQLSSATNSASETLAATPKAANDNANGRVPSARKVNGKALSADITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSGQFYPPGAPIPWPSDTVPSGYALMQGQTFDKSAYPKLAAAYPSGVIPDMRGWTIKGKPASGRAVLSQEQDGIKSHTHSASASSTDLGTKTTSSFDYGTKSTNNTGAHTHSVSGTAASAGNHTHSVTGASAVSQWSQNGSVHKVVSAASVNTSAAGAHTHSVSGTAASAGAHAHTVGIGAHTHSVAIGSHGHTITVNAAGNAENTVKNIAFNYIVRLA

SEQ ID NO: 40 - protein, 194 aa, Artificial Sequence
  Synthetic: STF84-AP1
MAFRMSEQPRTIKIYNLLAGTNEFIGEGDAYIPPHTGLPANSTYIAPPDIPAGFVAVFNSDEGSWHLVEDHRGKTVYDVASGDALFISELGPLPENVTWLSPEGEFQKWNGTAWVKDAEAEKLFRIREAEETKNSLMQVASEHIAPLQDAVDLEIATEEETSLLEAWKKYRVLLNRVDTSTAPDIEWPTNPVRE

SEQ ID NO: 41 - protein, 1283 aa, Artificial Sequence
  Synthetic: STF-93
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPSNRKVNGKALTADITLTPKDIGTLNSVTMSFSGGAGWFKLATVTMPQASSIVYIALIGGAGYNVGSPHQAGISELVLRAGNGNPKGITGALWKRTAVGLTNFAWINTSGDTYDIYVEIGNYATSVNIHWDCTANATVSIYTSPTYSASKPSSVTDGVVYTMYSTHQKPTPLDIGALPTTGGTVSGPLSVTGGITGTLNGNASTATKLQTARSIGGVGFDGSANINLPGVNTTGNQNTTGNAATATKLQTARTIGGVSFDGTANINLPGVNTTGNQNTTGNAATATKLQTARTINGVSFDGSANISLSPANIGCPASPTGWLTTGSNGGAITTAQLVTLLQNNGAFNTKSWIARCAWAYANSATIPNSETGCGVIPLAGAVIEVFNNGSSSNNYTIRITTATTTSVSGALTNAEFIYVFNGTDYSPGWRRVYNTKNKPTASDVGALPLTGGTLSGGLTSSGEIISKYANGFRIAYGSFGFFIRNDGSNTYFMLTASGDTLGSWNGLRPITINNTSGAVSIGNGLNVTGGVNGSLNGNASTATKLQTARNINGVKFDGSGDININTLVSRGRVTALSGSTQGTAGIQMYEAYNNSYPTTYGNVLHMKGASAAGEGELLIGWSGTSGAHAPVFIRSRRDTTDAAWSAWAQLYTAKDSIPGVNTTGNQNTTGNAATATKLQTARKIAGVAFDGSADITLTAANLNAYTKTEVTNLLSSYASRSSLTGYSGNLDIIAETLVVKSGGSGGFAIWDIGTTTSGANMYIDPNPGINTVWRSTSSRRYKKDIETLQDRYADELLSLRPVWYRSICRGDRKDWGYYGLIAEEVGEIAPQYVHWREPTNNDSPEDISSNGMVAEGVMYERLVVPLIHHIQQLTKRVEELETKLNSPKE

SEQ ID NO: 42 - protein, 798 aa, Artificial Sequence
  Synthetic: >STF-95
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRRVPSARKVNGKALSADITLTPKDIGTLNSTTMSFSGGAGWFKLATVTMPQASSVVSITLIGGAGFNVGSPQQAGISELVLRAGNGNPKGITGALWQRTSTGFTNFAWVNTSGDTYDIYVAIGNYATGVNIQWDYTSNASVTIHTSPAYSANKPEGLTDGTVYSLYTPSEQFYPPGAPIPWPSDTVPSGYALMQGQTFDKSAYPKLAAAYPSGVIPDMRGWTIKGKPASGRAVLSQEQDGIKSHTHSASASSTDLGTKNTSSFDYGTKSTNNTGAHTHSLSGSTGSAGDHTHGNGIRWPGGGGSALAFYDGGGFTYVQDSQYQVSPGTSSRRSYYQRIQTQSAGAHTHSLSGTAASSGAHAHTVGIGAHTHSVAIGSHGHTITVNAAGNAENTVKNIAFNYIVRLA

SEQ ID NO: 43 - protein, 194 aa, Artificial Sequence
  Synthetic: STF95-AP1
MAFRMSEQARTIKIYNLLAGTNEFIGEGDAYIPPHTGLPANSTDIAPPDIPAGFVAVFNSDEASWHLVEDHRGKTVYDVASGDELFISELGPLPENVTWLSPEGEFQKWNGTAWVKDTEAEKMFRIREAEETKNNLMQVASEHIAPLQDAADLEIATEEETSLLEAWKKYRVLLNRVDTSTAPDIEWPTNPVRE

SEQ ID NO: 44 - protein, 625 aa, Artificial Sequence
  Synthetic: STF-132
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRAVQRDGDTMTGELKIRGVNALRIFNDAFGLIFRRSEECLHLIPTSEGQGENGDIGPLRPFTINLRTGEISMSHKVSVGGGSQVNGALGIGVQNALGGNSIAFGDNDTGIKQNGDGILDVYANGQHVFRFQNGALQSHRAVNVSGRVTPTDYGNFDERYQTKTGGVQNFQYTSEVFHKPAGNEVSWVFRAPSGCTLSGINVQETGSNSADNIGGVYYKQAQIYINGAWRSVSG

SEQ ID NO: 45 - protein, 188 aa, Artificial Sequence
  Synthetic: STF132-AP1
MALSIRLIKAKIMELRNVTRYYPENMPYGEGVQYFRSEDGQDFYESLDKFAKKYKLCTHPETGVIYSMAEDVSRLYPAGFTIVEVDELPDGFCIEARWYYKDGEVLPVPVDYRLLAESERARLTAIAEREISDKKTDLLLGIINNGEKEMLKLWRMYIRNLKNIDFNHIHDKSSFDSIKWPCDPENSH

SEQ ID NO: 46 - protein, 1348 aa, Artificial Sequence
  Synthetic: K1F
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGAKGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 47 - protein, 1154 aa, Artificial Sequence
  Synthetic: K5
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSPKTEGILHKGQSLYEYLDARVLTSKPFGAAGDATTDDTEVIAASLNSQKAVTISDGVFSSSGINSNYCNLDGRGSGVLSHRSSTGNYLVFNNPRTGRLSNITVESNKATDTTQGQQVSLAGGSDVTVSDVNFSNVKGTGFSLIAYPNDAPPDGLMIKGIRGSYSGYATNKAAGCVLADSSVNSLIDNVIAKNYPQFGAVELKGTASYNIVSNVIGADCQHVTYNGTEGPIAPSNNLIKGVMANNPKYAAVVAGKGSTNLISDVLVDYSTSDARQAHGVTVEGSDNVINNVLMSGCDGTNSLGQRQTATIARFIGTANNNYASVFPSYSATGVITFESGSTRNFVEVKHPGRRNDLLSSASTIDGAATIDGTSNSNVVHAPALGQYIGSMSGRFEWRIKSMSLPSGVLTSADKYRMLGDGAVSLAVGGGTSSQVRLFTSDGTSRTVSLTNGNVRLSTSSTGYLQLGADAMTPDSTGTYALGSASRAWSGGFTQAAFTVTSDARCKTEPLTISDALLDAWSEVDFVQFQYLDRVEEKGADSARWHFGIIAQRAKEAFERHGIDAHRYGFLCFDSWDDVYEEDANGSRKLITPAGSRYGIRYEEVLILEAALMRRTIKRMQEALAALPK

SEQ ID NO: 48 - protein, 1075 aa, Artificial Sequence
  Synthetic: STF-37
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSELSGEHGSFLIGGVIDCYSTVSDLISSSPSVGRVCRTIGYYSPGDGGGADYIISIGTPMQDFSDSGSIVIDECKFAKLIQQSQYDLKQFGVKPSDPSYAEKNDIFISQAITRSRVGRCKIIISDVIYHKKPLIFDYYNHMEGSCIGSDPEFTPRFIKIDNTTSGLPDMGYPGVADVVSYDVDAGIIIKRQNSGTSFARGFIIKGFLLQSEKKSAWAIYAPHMADFDIDIDSRGFNGGIRWFVNFLGRMAGRHIGLGANSSDPTLSIGAWCSKFSTIPDCGNSVVFRLSFNGFNRGMQMEYFGNGVLDRVTLENISKPTPTSPTTHGIYATDTWLTGQVSCESSSTCIIRAGNNANFDITLSAVFHVTQDDPSEGIVHVLNGGRLTLRSSTILADLADTKIINENGGYLDIAANTRTGNIVYSNSDNYRFKDRTIGFGQTAATTKTSFSSGEEITFSLLNGTPKANLSGGTIQFNSPCLIKITVQGRGITSGALTFGINGESSESVSQGQQVSMVVGVVSGDILNLKATSSLTLGSAGGVRVLLEPVN

SEQ ID NO: 49 - protein, 955 aa, Artificial Sequence
  Synthetic: 1JL
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGYKVQSLAILSDTQAVHDATNTIKTQTDKIKADTQAIKTQTNQIKTETGVIRDKANTAKTDAQAASAAAQGFRDQAKEWAQSVNADNLLTKTGNLAGLTDKSAARSNLGLGSVATENTVPIKKGGTAATTVAAARSNLGLGSVATENTVPIEKGGTAATTAAKARSNLGLGSVATENTVPIEKGGTAATTAAKARSNFGLGDNNKVKLGTLRLNGGESLVFNDVERNGLIISNASFGIDSWVGQTMHKWYTDWTRAGLVRAGDAHLSDYRVHVWKDGFTEALFRFLPDGRLISGNSGNPSVNEFQKAPLSDRDLKKEIKYTDGEESYNRVRQWLPAMFKYKESDVQRYGLIAQDLARIDPEYVHLLPGYAIYEDVKGVDEEGNEVVVDRKEIGYTDDVLSLDSNVLLMDLCAAFVHLLHKVEKLEGK

SEQ ID NO: 50 - protein, 1051 aa, Artificial Sequence
  Synthetic: STF-48
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSQLESDADGMGDALVAVKQPYIGSIALTQHDKNTNFISAKDFGATADGTLHPLSEKFSTLSAAQAVYPFVTSLTQSLDYAGIQAAINTGRNVLLTSGTYFVNATIEMNSNCTINGETNSNINRPETFIAVIGNIACFHYHAAFNTINIENVYIFYDGGRPTSPTGNDGKIGILIDGGTTSPGVMHIKNVEVDGAWWAIYDDSGNYLTKYTQVWARRVAHGFYKANGTTIQWDTCYVLDAAQAWYVVNCLSPQLINCAGDQITVDGSQYTFDSSGLYFSGCKCLTITGYDGESNIIKNTNGITASYIKLNDTIAHISGLAGHGNSMQTTGSGTAAFIFATGTSIVNIKSSTDSFLDSESITYTGSGYPNTLLTDSTAKIIAEGCRFKAPTGGTPVISTYSTGNGVFTDCSLTGTQTSGSYVESRSSAGNQLPAVYTAKGTQAVAANVATTLFELPNSQGMYLISVWAESSGTNFSSLQLAMWDGTTLTLTPLKSGGLISFTVTGRIVTITSQGTTTFNWTYTKAG

SEQ ID NO: 51 - protein, 1365 aa, Artificial Sequence
  Synthetic: STF-49
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSGAIGDGVHDDTSALSELLSVATGGEKIDGRGLTFKVSTLPDVSRFKNARFLFERIPGQPLFYASEDFIQGELFKITDTPWYNAWTQDKTFVYDNVIYAPFMAGDRHGVNNLHVAWVRSGDDGRTWTTPEWLTDLHENYPTVNYHCMSMGVVRNRLFAVIETRTVSGNKLQVAELWDRPMSRSLRAYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTRGTLSTQPGSSLHRSSDLGTSWNSLRFPNNVHHSNLPFAKVGDELIIFGSERAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDFVYGATPNRTLPTFMSTSGVRTVPVPVDFTDDVAVQSLTVHAGTSGQVRAEVKLEGNYAIIAKKVPSDDVTAQRLIVSGGETTSSADGAMITLHGSGSSTPRRAVYNALEHLFENGDVKPYLDNVNALGGPGNRFSTVYLGSNPVVTSDGTLKTEPVSPDEALLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVMEDIIERVEITPAGSRWGVRPDLLFYIEAAWQRREIERIKARLDLIEGKH

SEQ ID NO: 52 - protein, 1051 aa, Artificial Sequence
  Synthetic: STF-52
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSQLASSEDGMGDALVAVKQPYIGSIALTQHDKNTNFISAKDFGATADGTLHPLSEKFSTLSAAQAVYPFVTSLTQSLDYAGIQAAINTGRNVLLTSGTYFVNATIEMNSNCTINGETNSNINRPETFIAVIGNIACFHYHAAFNTINIENVYIFYDGGRPTSPTGNDGKIGILIDGGTTSPGVMHIKNVEVDGAWWAIYDDSGNYLTKYTQVWARRVAHGFYKANGTTIQWDTCYVLDAAQAWYVVNCLSPQLINCAGDQITVDGSQYTFDSSGLYFSGCKCLTITGYDGESNIIKNTNGITASYIKLNDTIAHISGLAGHGNSMQTTGSGTAAFIFATGTSIVNIKSSTDSFLDSESITYTGSGYPNTLLTDSTAKIIAEGCRFKAPTGGTPVISTYSTGNGVFTDCSLTGTQTSGSYVESRSSAGNQLPAVYTAKGTQAVAANVATTLFELPNSQGMYLISVWAESSGTNFSSLQLAMWDGTTLTLTPLKSGGLISFTVTGRIVTITSQGTTTFNWTYTKAG

SEQ ID NO: 53 - protein, 931 aa, Artificial Sequence
  Synthetic: 1AR
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSIATRVSKEGDTMTGKLTLSAGNDALVLTAGEGASSHIRSDVGGTNNWYIGKGSGDNGLGFYSYITQGGVYITNNGEIALSPQGQGTFNFNRDRLHINGTQWTAHQGGGWENQWNQEAPIFIDFGNVGNDSYYPIIKGKSGITNEGYISGVDFGMRRITNTWAQGIIRVGNQENGSDPQAIYEFHHNGVLYVPNMVKTGARLSAGGGDPVWQGACVVIGDNDTGLVHGGDGRINMVANGMHIASWSSAYHLHEGLWDTTGALWTEQGRAIISFGHLVQQSDAYSTFVRDVYVRSDIRVKKDLVKFENASEKLSKINGYTYMQKRGLDEEGNQKWEPNAGLIAQEVQAILPELVEGDPDGEALLRLNYNGVIGLNTAAINEHTAEIAELKSEIEELKKIVKSLLK

SEQ ID NO: 54 - protein, 259 aa, Artificial Sequence
  Synthetic: 1AR-AP1
MAVTGPWVGSSAVVNTGQNWMVGAAQRLRMGAPFWMSNMIGRSVEVIHTLGADHNFNGQWFRDRCFEAGSAPIVFNITGDLVSYSRDVPLFFMYGDTPNEYVQLNIHGVTMYGRGGNGWAAGAIGASDGGVCIQNDIGGRLRINNGGAIAGGGGGGGGYSQANNWAGKYVCGGGGGRPFGLGGNNGARWPGGNASLTSPGAGGNTGTRYYAGGGGEVGQPGQYANPGAGYSTPPTSPGAAVAGSAPTWQNVGAIYGPRV

SEQ ID NO: 55 - protein, 80 aa, Artificial Sequence
  Synthetic: 1AR-AP2
MSEQTIEQKLSAEIVTLKSRILDTQDQAARLMEESKILQGTLAEIARAVGITGDTIKVEEIVEAVKNLTAESTDEAKDEE

SEQ ID NO: 56 - protein, 901 aa, Artificial Sequence
  Synthetic: 13-13.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 57 - protein, 259 aa, Artificial Sequence
  Synthetic: 13-13.0-AP1
MAVVGVPGWIGSSAVNETGQRWMSQAAGQLRLGVPCWMSQFAGRSREIIHTLGADHNFNGQWFRDRCFEAGSTPIVFNITGDLVSYSKDVPLFFMYGDTPNEYVQLNIHGVTMYGRGGNGGSNSPGSAGGHCIQNDIGGRLRINNGGAIAGGGGGGGGGRYGRLSFGGGGGRPFGAGGSSSHMSSGATAGTISAPGAGSVGEGSLWVYTGGSGGNVGAAGGRCNIQGNGTEYDGGAAGYAVIGSAPTWINVGAIYGPRV

SEQ ID NO: 58 - protein, 80 aa, Artificial Sequence
  Synthetic: 13-13.0-AP2
MSEQTIEQKLSAEIVTLKSRILDTQDQAARLMEESKILQGTLAEIARAVGITGDTIKVEEIVEAVKNLTAESADEAKDEE

SEQ ID NO: 59 - protein, 761 aa, Artificial Sequence
  Synthetic: 13-14.3
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 60 - protein, 259 aa, Artificial Sequence; identical to SEQ ID NO: 57
  Synthetic: 13-14.3-AP1

SEQ ID NO: 61 - protein, 80 aa, Artificial Sequence; identical to SEQ ID NO: 58
  Synthetic: 13-14.3-AP2

SEQ ID NO: 62 - DNA, 2058 bp, Artificial Sequence
  Synthetic: >STF-25
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacagcagcggcatcgtccaggaacgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgagctgaaaaggcggcagaccgcgcagaagccgcagcggaagtgactgcagagccctgtgcgaatatagtgccgccgctgcctgatgtgtggataccgtttaacgattcactggatatgattgcgggtttttctccgggctataaaaaaatagctattggtgacgatgtggttcaggtcgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaactacatgctcaattcggaaagtccagccagctgggggaagtcatcaaacatggatgtgcccgaaaccgggacggatagttttggttttacttatggaaagtttgtctgcaacgattctctggttgggcaaacttcggctattaatatggcatcaattgctgcaacaaagtcagttgatgtctcaggcgataacaagtacgtgacaacctcatgccgttttaaaacagaacgacaggtaaggttacgtatacggtttgataagtatgatggtagtgcaacaacttttcttggcgatgcgtacattgatacgcaaacgcttgaaattagtatgacaggtggtgctgccggcagaattacggcacgagtcaggaaggataagaccacgggctggatttttgcagaggcaacgattcaggcaattgatggtgagttaaaaataggctctcagatacagtattctcctgggcagggtggggcaacagtatctggtgactatatttatcttgccaccccacaagtagagaatgggccgtgtgtatcatcatttattatttcaggaggcagcgcaacgacaagagccagtgatttggttagtatccccaccagaaataatctttataagttaccatttacttttttacttgagattcataaaaactgggatattgcaccaaacgccgcaccccgcgtgtgggatatagcagcagccaataccgggcaatcagcaattgcagcaatcaacagaggtagtggtaagttatatatgagtctgtcaaacccttcaggctcgtatgttaatagcgcagcgacagatgtatttgcagagaaaaccacatttggatgtattgcaaaagctgatggtcactttcatgtggtgacaaatggtaaagcggttaatgaagtttattgtgaatataatggcgtgaccgctgataaaaatatccgatttggagggcagacgaatactggagaacgacatctgtttggccatattcgcaatttccgcatatggcataaagaattaaatgacaggcaattaaaagaggtcgta

SEQ ID NO: 63 - DNA, 276 bp, Artificial Sequence
  Synthetic: STF-25-AP1
atgaaagatttaactttgaagtttcatgacaaactgcagtttaaggccttcctgtcatctcttggctgggcggaagatgaagacctccagaataaactgttagttgatgaaattggtttcacctacacagaaacaggggtaacagaagagggagaacctgtctgtatccggaatgatggttattttgtcaacattcgcattcttgatgacttgtttgatgtttctgtattctctgattatgtcgtggagctggaaacaccgcttcgggaatggagc

SEQ ID NO: 64 - DNA, 2061 bp, Artificial Sequence
  Synthetic: STF-27
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccagcgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaacttcttccagaacagtacagacccttcgaagtggaataagtcaacttcactggacgttacagaaacaggcacagatagtttcgggtttaattatggtcggtttgtcgtacaggattcgattgttggtacaagtaaagcgcataccattatcggactgtattcgagtaccggaggggttgatacttcaggggacgaaaagcatgtaactatatcctgtcgggtaaaaagtgaagttgataatatcgccgttcgtattttatttgaacattatgatggggaggtaaggacatcaataggagcagcaaacctgaaccttaccacccgcataattagcaagacaggtcagacaagccgtgttacagcaaggtctgttaaggatgatgcaactggctggatattttttgaggctacattaaaagcagatacaacagaaaatacggttggtggttttgtccagtattctccggatacagggcagatggttacatcaggggattatctcgatgtaaccactccacagattgaggctggtacaggcgcatcatcttttattgttacggggacggcaccggcaacgcgggcaagcgatatggtgacagtcccaatcaagaataacctttataatcttccttttacggttctttgtgaggtacataagaactggtataaaacgccaaatgtagcgccgcgtgtttttgataccggcggtcatcaaaccggagcggggatcgtaatggggtttggttcatcaggtgggtacgacggttttccgtattgcgatataggtggttcagaccgacgaataaatgaaaatgccgggctggaaaaaatgcttattggtatgcgggtaaagtccgaacggtccacatgtgtagtcagtaacggtaagttaagcagcgaaactaaaaccaaatgggaatatatccggagtacagcaaccattcgcattggtggacaaactacagcaggattacgccatttatttgggcatgtgaggaattttcgtctctggcataaagagctaacagatgcgcagcttggggaggttgtggag

SEQ ID NO: 65 - DNA, 276 bp, Artificial Sequence
  Synthetic: STF27-AP1
gtgagagatttcacgttgcgtttcagtgataaagcagatttcagggcatttctcaggaaacttaactgggaagaggacgaagagctgcagaatgccgttctggttgatgagattggttttacgttcagggagacagatgtttctgatgacggagaaccagaatacacgcgaaacgaagggtactttgttaatatccgtcttcttgacgatggatttgaggattccgtgttccgtgagtgggtggttacaccagagcgcccgctcagggagtggttt

SEQ ID NO: 66 - DNA, 264 bp, Artificial Sequence
  Synthetic: STF27-AP2
atgctgccgcagcatagcgatattgaaatagcctggtatgcttcgatacagcaggagccgaatggctggaagaccgtcaccacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcaactgcacctgatattgagtggccgacttcacctgcagag

SEQ ID NO: 67 - DNA, 2019 bp, Artificial Sequence
  Synthetic: STF-28
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagaaacagcagcggcatcgtccaggaacgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgagctgaaaaggcggcagaccgcgcagaatccgcagcggaagtgactgcagagccctgtgcgaatatagtgccgccgctgcctgatgtgtggataccgtttaacgattcgctggatatgattacgggtttttcgccatcttataaaaagattgttattggtgacgatgaaataacaatgccaggcgacaagattgttaagtttaaacgtgcttcaacagcaacgtatattaataagtccggccaactcaagcttgctgaagttgacgaaccgcgatttgagcgcgatggcttattgattgaaggacagaggacaaattatctgaggaactcaaataaaccagactcatggactgttcattccgcactgaataaaacatttggcactgataaacaggggttcaattatgccacggtgacacccacggaaagtatagtgggaacaacaggtggctatactgtgcatggtgtggttgcagcagacagattcccgctggcaagtggtgaatgtttcactttttcgtgccgggttaaaggcgctaaagcacgatgcaggttaagagtttcagttattattggtggaacagatacattctctgctgactcttatcttgatctggatacccggatcgcaacagtaagcggtaatacatcccttataacagccaaagctgaacaacagggcgagtggacctactatgaggccacttatacagctaatacggacattgataccgttaactgtgctttttatatgacaaataaaataagtaatgagccattctatgatgactcaacattaaccatgacgacgccgcaaattgaactgggcaatacggcatcgtcatttattgtaactacaatgccaacaacacgcgcaagtgatgtggttactatcccctcggcgaataacctgtcaacacggccttttacagtattgtgcgaagtaaggaggaactggagtacaccgcccaatgttgcgccaaggatatttgatgttggagggcacagtattgatgataattatttatcgctggggtttgtttcaacaggaaagataagcgccaacgtaggaatggttcagccacaaatttcctcagatggagaaaggttcattgtgggtgtgagagctaaatctgatttatcagtaaatgcaatatgcaatggtaattatacaacaaaccttaatggtaaaatatttggagttacagcaacatcgtaccggtttggtgggcagaccgcagcaggaacgcgtcatttgtttggacacatcagaaatttcagagtctggtttaaagaattaaatgacaggcaaatcaaggaggcagta

SEQ ID NO: 68 - DNA, 276 bp, Artificial Sequence
  Synthetic: STF28-AP1
atgaaagatttaactttgaaatttcctggtaacagagagtttaaatccttcctgtcatctcttgactgggaggaagatgaagacctccagaataaactgttagtcgatgaaattggtttcacctacacagaaacaggggtaactgaagagggagaacctgtctgtatccggaataacggttattttgtcaacattcgcattcttgatgacttgtttgatgtttctgtattctctgattatgtcgtggagctggaaacaccgcttcgggaatggagc

SEQ ID NO: 69 - DNA, 2394 bp, Artificial Sequence
  Synthetic: STF-15
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgcaactgcatcagctaacagtcaaaaagcagcaaaaaccagtgaaaccaacgcaaaggtgagcgaaacagcggctgcgaactcagcgaaagcatcggcagcaagccagacggcagctaaagcaagcgaagatgcagccagagagtatgcaagtcaggcagcagagccgtataaatatgtcttacagccactgcctgatgtgtggataccgtttaacgattcactggatatgattacgggcttttcgccgtcatataaaaaaattgttattggtgatgatgaaataacgatgcctggcgacaaggttgttaagtttaaacgcgcatcaactgccacatatatcaataaatcaggcgtatttagtgttgctaaaattgatgagccacgatttgaaaaagaaggtttattgattgaaggacagcgcactaactattttgttaaatccaatactcccgctgaatggacgagtaccagcaatatcgataaaactaataatggtgttgatgaatttggtttttcatatgccaaaatgcgaacaaaagataatatgacaggacaatcatctgcacttagtctgcatagatgcagtgcatcccgggggattgatgttagtggcgataataagtattgcactgtttcatgcagggttaaagctcctgatggtcttcgttgtcgtttgcgttttgaaaaatacgatgggtcggtttatacatttttaggagatgcttatttaactttcggaactctgataatagaaaaaactggcggggcagccaatagaatagcagctactgcaactaaagatccggttacagggtggattttctatgaggcaactatagaagctgttgaaggtgaaaccttaattggcgcaatgattcagtatgcgccgaaaaaaggtggtataactgaagcgggagattatatttaccttgcaacaccacaatttgaaaacggcggatgtgcttcatcttttgttattacgacaactgcacccgcaacccgctccagtgatatggtgacgattccaactaaaaataatatctataatagaccgcttacgtgtcttgtcgaggttaatagaatttggggcgatattcctcctaatgtagcaccgcgtatttttgatttttctggtgtgccacctattgagtcaattacatacgcttttaacacaactgagaaatattacggtcagctttatatgcaaacttataaagcgtcgacaagtacttacgtttctagtgtgtttgctggtcgagctgatgttcgaaaattcattggtggttttaatatttattctgatggtactaaacgagtagtttctaacggtgaggctactaaaactatgaaaacggagtggacgggcgtaaaaacacggacctttattcgaattggaggtcaagccacatcgggaactcgtcatctattcggccatttgagaaatcttcgtctctggcataaagaattaactgatgcgcaaatgggggagagtattaaa

SEQ ID NO: 70 - DNA, 279 bp, Artificial Sequence
  Synthetic: STF15-AP1
atgaaagatttaacactcaaatttgcagacagggccgacttttcggcctttatggagagcattggctattatgatgacgagtcgatgcaggatgatattcttattgacgtgataggtaatgtgtacaaagaaaccggagaacttactgaagatggcgagccggcatgtgttaaggaggacggatattttgtaaatgtgcgcatcattaatgattcgcaaatatcgtcattattcgatgaacacgcggttgctgttgagcatcaactccgtagctggatg

SEQ ID NO: 71 - DNA, 702 bp, Artificial Sequence
  Synthetic: STF15-AP2
atggctacatcgacagtaattcctgatgacatcaaaacgctaaagggagatgtcagtaaggcaaaggaagatatttcctcaattaacgtaaaagtatcaacgcttcagactgatatggacagtgcaaagcaggatatcagtaccagatacacaaaaacagaagtggataataagctgaaaaacaaagtggaagtgaacgatctggaaagtggtcgttatggcggagatttttacccgctgactggccgtgaagcgttttatttatggggattgggcacaactacagcggcggcaaatctttatcttaatcctgaccctgcaatttcgtctgtgctgcggtcaacatcgtctatccgctataaacattcagtagagacgatagattcagagcacgccgatctcattttcaggatgcgccctgtgtggtacaggtcgcaatgcgaaaatgacaggcgtgactggggattctatggattgattgccgaggaagtaggagaaattgcccctcagtttgttcactggcgaccagccaacgaagatgatgcaccggaaaccatttccagcaatggccttgttgccgaaggtgtaatgtacgaacgtctggttgttccactgattcaccatatccagaaactgactgaaagagttgatgaacttgagtcagaattgaagttgttatcaacttcccaaagcgatatcgga

SEQ ID NO: 72 - DNA, 2373 bp, Artificial Sequence
  Synthetic: STF-16
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatcagccaacagtcaaaaagcagcaaaaaccagtgaaaccaatgcaaagacaagcgagactgcagcggcgaactcggcgaaagcatccgctgcaagccagaccgctgcaaaagcaagtgaagacgcagccagagagtatgcaagccaggcagcagatccgtataaatatgtcttacagccgctgcctgatgtgtggataccgtttaacgattcactggatatgattacgggcttttcgccatcatataaaaagattgttattggtgacgacgaaataacgatgcctggcgacaagattgttaagtttaaacgtgcatcgaaagcaacctatattaacaaatctggtgtgctgacagaggctgccattgatgagccacgatttgaacgtgatggcctgcttattgaggggcaaagaactaatcttctgcttaattcaacaaatccatctaaatggaataagtcaggcaatctggaactcacagaaatatccacggattcttttaattttacttatgggagatttactgtaaaagatactcttattggtcagacaagtgctattaatatcgtaacgatttctggcagtaaagggtttgatgtcacaggtgatgaaaaatatgtgaccatttcatgccgtgtaagaagtgatgttgaaaatataaggtgtcgtttaagatttgaacaccatgatggttatacttacacttttttgggagatgcttacctcaatttatcaacacttgtaattgataaaactggtactgctgcagaccgtattattgcaaaggctgtaaaagatgaggttactggttggattttctatcaggctacaattaatgcactagatacagagagcatgattggtgcgatggttcaatacgctcctgtaaaaggttcaggtacagcatctggagactatctggatatcgcaactccacaagtggaaggtggatcaagtgcttcgtcatttattgtaactgatataactgcaagcactcgcgcaagcgatatggtgacagtcccaatcaagaataacctttataatcttccttttacggttctttgtgaggtacataagaactggtataaaacgccaaatgcagcaccgcgtgtttttgataccggcggtcatcaaaccggagcggctattattcttggcttcggtcgttcaacagattacgacggatttccttattgtgatataggtttggctaacagacgggtaaacgaaaacgcatcgcttgaaaaaatggttatggggatgcgtgtaaagtcagatcagtctacgtgctcagtaagtaacgggcgtatatccagcgaaaagaaagccacatggtcctatattcagaactccgcaattatccgtattggaggccagactacagccgggttgcgtcatttatttggtcatgtcaggaatttcagaatatggcacaaggcattgactgatgctcagatgggggagtcaatc

SEQ ID NO: 73 - DNA, 279 bp, Artificial Sequence
  Synthetic: STF16-AP1
atgaaagatttaacactcaaatttgcagacagggccgacttttcggcctttatggatagcattggctattatgatgacgagtcgatgcaggatgatattcttattgacgtgataggtaacgtgtacaaagaaaccggagaactgactgaagatggcgaaccggtatgtgttaaggaagatggatattatgtaaacgtgcgcatcattaatgatgcaaaaaaatcgtcaatattcgatgaatacgcggttgtagttgaacatcaacttcgtggctggatg

SEQ ID NO: 74 - DNA, 702 bp, Artificial Sequence
  Synthetic: STF16-AP2
atggctacatcgacagtaattccaggagacatcaccacgttaaagggagatgtcagtaaagccaaggaagatatttcctcaattaacggaaaagtatcaacgcttcaggctgatatgaccagtgcaaagcaggatatcagcaccagatacacaaaaactgaagttgataataagctgaaaaacaaactggaagtgaacgctctggaaagcggtcgttatggtggagatttttacccgttgactggccgtgaagcgttttatttgtggggattgggcacgactacagcggcggcaaacctttatcttaatcctgaccccgcaatttcgtctgtgctgcggtcaacatcgtctatccgctataaacattcagtagagacaatagattcagagcacgccgatctcattttcaggatgcgccctgtgtggtacaggtcacaatgcgaaaatgacaggcgtgactggggattctacggattgattgccgaggaagtaggagaaattgcccctcagtttgtacactggcgaccagctaacgaagatgatgcaccggaagctatttccagcaatggccttgttgccgaaggtgtaatgtacgaacgtctggttgttccactgattcaccatatccagaagctgactgaaagagttgatgaacttgagtcagaattaaagttgttatccgtttcccgaagcgatatcgga

SEQ ID NO: 75 - DNA, 2373 bp, Artificial Sequence; identical to SEQ ID NO: 72
  Synthetic: STF-17

SEQ ID NO: 76 - DNA, 279 bp, Artificial Sequence; identical to SEQ ID NO: 73
  Synthetic: >STF-17-AP1

SEQ ID NO: 77 - DNA, 2374 bp, Artificial Sequence
  Synthetic: STF-13
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcatcttctgccactgcatcagccaacagtcaaaaagctgcaaaaaccagtgaaaccaacgcaaaggcgagcgagactgcggcggctaactcggcgaaagcatccgctgcaagccagacggctgcaaaagcaagtgaagacgcagccagagagtatgcaagccaggctgcggagccgtataaacaagttttgcagccgcttcccgatgtgtggataccgtttaacgattcactggatatgcttgctggcttttcgcctggttataagcaaataactgtaggtgatgatgttattaaaatgccatccgataaggttgttagcttcaaacgcgcatcaggtgcaacatacattaataaatcaggagtattaaccgttgctgaagttgacgaaccgcgatttgaacgagaaggtttgctgattgaaggacaaagaaccaactatcatcttaattcacttacgccatctaagtggggagctacaacaagtgtaactataacagaaagtggtgttgatgagtttggctttacttatgggcggtttcaaataaaggacgaaaaaattgggacaaatacgacaatgaatatcgctgcggtttcaggaggaagaggtgtcgatgttactggaactgaaaagtatgttacaacatcatgtcgtgtaaaaagcgatagtgctaatatacaatgtcgtataagatttgaaagatatgacgggtccgcatatttttatctggcagatgcatatcttaatataacagatatgtccattaggaaaacgggaggaggggctgcaagaataaccgcccgagcggagaaagaatctaatggatggatttatttcgaggttacatatcaatctgaagctattgataatatggtgtggctctcagatccaaattgctccacctgtttcacctggaacttatttgggcggggaatatttggatgttacgacaccacaatttgaaggcggctcatgcgcatcatcttttatcatttccgatacagttgcatcaacgcgagcaagcgatattgttacattgccttgtaaaaataacatggccagcaaacctttaacctgcatggttgaagtgaataaaaattggtctatagcaccaaattccgcgcctagaatttatgatataacaggatttaaaacaaaagacgacgcttttgtttttgcattcagaaatacagcaggtagtgtaggaactccatatgttcaatttggtaatccaatatcatttccacctggaaattacccaagaaagattatcgctgtatatagaataaaaagcgatggcaagtttcaggctggctgcaatggggttttatcaacaccagcatcaacaacgtggaagagtgttagtggtgctacaggtataaggattggaggccagactacagccggcttacgtcatttatttggttatatcaggaattttagaatatggcataaagaattaaccgatgcgcaaatgggagagataata

SEQ ID NO: 78 - DNA, 279 bp, Artificial Sequence
  Synthetic: STF-13-AP1
atgcgagatttaattatcaaattcacagacaaggccgacttttcggcctttatgaagagtgctggctattatgatgacgagtcgatgcaggatgatattcttattgacgtgataggtaacgtgtacaaagaaaccggagaacttactgaagatggcgagccggtatgtgttaaggaagacggatattttgtaaacgtgcgcatcattaatgatgcaaaaaaatcgtcaatattcgataaatacgcggttgttgttgagcatcaacttcgtggctggatg

SEQ ID NO: 79 - DNA, 702 bp, Artificial Sequence
  Synthetic: STF-13-AP2
atggctacatcgacagtaattccaggagatatcaccaagctaaagggggatgtcagtaaagctaaggaagatatttcatcaattagcagaaaagtatcaacgcttcagactgagatgaccagtgcaaagcaggatatcagctccagatacacaaaaactgaagttgataataagctgaaaaacaaagtggaagtgaacgatctggaaagtggtcgttatggcggagatttttatccactgacaggtcgtgaagcgttttatttatggaatttggccacgactacagcggcggcaaacctttatcttaatcctgaccctgcaatttcgtctgtgctgcggtcaacatcgtctatccgctataaacattcagtagagacaatagattcagagcacgccgatctcattttcaggatgcgccctgtgtggtacaggtcgcaatgcgaaaatgacaggcgtgactggggattctacggattgattgccgaggaagtaggagaaattgctcctcagtttgtacactggcgaccagctaacgaagatgatgctcctgaagctatttccagcaatggccttgttgccgaaggtgtaatgtacgaacgtctggttgttccactgattcaccatatccagaaactgactgaaagagttgatgaacttgagtcagaattaaagttgttattaacttcccgaagcgatattaga

SEQ ID NO: 80 - DNA, 2343 bp, Artificial Sequence
  Synthetic: STF-12
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatcagcaaacagtcaaaaagctgcaaaaaccagtgaaaccaatgcaaagacaagcgagactgcagcggcgaactcggcgcaagcatcggcagcaagccagacagcagctaaagcaagtgaggatgcagccagagagtatgcaagccaggcagcagagccgtataaatatgtcttacagccactgcctgatgtgtggataccgtttaacgattcactggatatgcttgctggcttttcgcctggttataagcaaataaccgtaggtgatgatgttattaaaatgccatccgataaggttgttagcttcaaacgcgcatcaggtgcaacatacattaataaatcaggtgtattaaccgttgctgaagttgacgaaccgcgatttgaacgagaaggtttgctgattgaaggacagagaacaaactatttcagaaattcaaatacaccagaagcatggaataacacgggtagtgtgtctgttgagtcgttcgacagtgataaggggtttaactatggaaggataactgttattaatgaaaatccgacagcacaaggatatcaggcaattgctgtaaacacgaatgatgcttacacctgcccggcaggttcttatacgacgatatcgtgtctgacgaaaagtgataattcccggtgtcgtgcaaggttcggaaaaatgtctgataatggtgcgtttgtttttcattcagatgcagttctggatcctgttacgggaaatgttgttcatggaaataatgtgacggtgacggcagaaagagtcggtgaatggtggttgtttaccgccactctttttgcagatgcggaaatgataatcagctcaagatttgaaatcctggcgatgcctggaatcagtattatccccaatggctctacgttagatattgcgatgcctcaggcggagattgggtcgtacaggacgtcatttatcattactgaaggggctcctggcactcgctccagcgacatggtgacaatacctgtaagaaacaatattcaccgattaccattcagtgctcttgttgaagttaataaaaactgggatatccctcccagcaaatcaccattaatctttaatgttaaagattatcaggaaaatggtctgttcacgcatggattccgtggtaataatttctctgatgccggttctccttttatttctatgggagggtgtaataaatatgtggcaacaacccagaggaaaatcatttcaggcttccgttgtggcgctgatggagatgttcaggccgtatgtaatggtgaattatctgttgcggcaaaaacaacatggacttcaattgttccacgggcagtattgcgaattggagggcagggcactaatggggagtatcatctttttggtcatatccgtaatctgcgtatctggcataaagaattaactgatgcgcaaatgggggagagtattaaa

SEQ ID NO: 81 - DNA, 279 bp, Artificial Sequence
  Synthetic: STF-12-AP1
atgaaagatttaacactcaaatttgcagacagggccgacttttcggcctttatggagagtattggctattatgatgacgagtcgatgcaggatgatattcttattgacgtgataggtaacgtgtacaaagaaaccggagaactgactgaagatggcgaaccggtatgtgttaaggaagacggatattttgtaaacgtgcgcatcattaatgatgtaaaaaaatcgtcaatattcgataaatacgcggttgttgttgagcatcaacttcgtggctggatg

SEQ ID NO: 82 - DNA, 702 bp, Artificial Sequence
  Synthetic: STF-12-AP2
atggctacatcgacagtaattccaggagatatcaccacgctaaagggagatgtcagtaaaactaaggaagatatttcctcaattaacggaaaagtatcaacgcttcagactgatatgaccagtgcaaagcaggatatcagcaccagatacacaaaaactgaagttgataataagctgaaaaacaaactggaagtgaacgatctggaaagcggtcgttatggtggagatttttacccgttgactggccgtgaagcgttttatatgtggggattgggcacgactacagcggcggcaaacctttatcttaatcctgaccctgcaatttcgtctgtactgcggtcaacatcgtctattcgctataaacattcagtagagacgatagattcagagcacgccgatctcattttcaggatgcgccctgtgtggtacaggtcgcaatgcgaaaatgacaggcgtgactggggattctacggattgattgccgaggaagtaggagaaattgcccctcagtttgtacactggcgaccagctaacgaagatgatgctcctgaagctatttccagcaatggccttgttgccgaaggtgtaatgtacgaacgtctggttgttccactgattcaccatatccagaagctgactgaaagagttgatgaacttgagtcagaattaaagttgttatccgtttcccgaagcgatatcgga

SEQ ID NO: 83 - DNA, 3777 bp, Artificial Sequence
  Synthetic: STF-63
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcaaattccgcgacagcagccaaaaaatcagaaaccaacgcgaaaaatagtgagtcagcagcaaaggtcagcgaaaccaacgctaaagcgtcagagaacaaggcgaaagaatatctcgacaaggtcgggggactcgtcagcccgatgacgcaatacgattggcccgttgttactggtaatgagtctttttacataaagatcgcgaaactttccgatcccggaagcaacaattgccatgtaacgctaatggttactaacggcggtgactacggctccccttacggaaacattgactttatcgagatctcggcgcgcggtctgccttcttcgcttactgctgataatgtatctcgttacctgagtatacgccgtttagggccaaccgggctaatcaatagcatgcaaatgcgttacggcctggttaaagatgatggctttattgaggtttgggccttccagcgtgcatttatcaacggcgcaaaggttgcggtactggcgcagacggcacgcacggaattatacattccagacggatttgttaagcaaaccgccgcgccttctggatatgttgaaagccccgttgtaaggatttacgaccagttaaacaagccgactaaagcagatttgggtctttctaatgctatgcttacaggcgctttcggtcttggcggtagcgggatatcaacaaacggcaagatgagcgatgtagagatcttaaaagctctgcgtgacaaaggtggtcatttctggcgcggtgataagccgaccggaagcacggcgaccatttatagccacggttctggtatattctcgcggtgcggcgatacgtggtcagcgatcaatatcgactactcaaccgcgaagattaagatctatgccggcaacgatgcccggcttaacaacgggacttttagcatcaatgagctatacggctcggcaaacaagccgtcgaaatcggatgttggacttggcaacgtaacgaacgatgcgcaggtaaaaaaaaccggcgatacaatgaccggtgacttgacaatcaaaaaaggtacaccgtcagtcttcctgcgggcagacagtggagtcaccgctttgcggttttatactggcgataacacagagcgcggcataatctatgctggtcctaacactgattcgcttggcgaagttcgcatcagggcaaagacagcaggggggacatcaggaggggatcttgttgttcgtcacgacgggagggttgaagtccgtgatctcacagtagcgtataaaattaaaagcagaacgattgagattgcaaataccgatactgactcatcggcaactacgctcagcatctatggagtacagcacacgccgttggttttaacgcgttctggttcttctgaaaatgtgtccattgggtttaagttagacaacatgaacccaaagtatcttggaattgatactaatggggatctggcttttggtgagagtcctgatcagaaacaaaacagcaaattgatcacgcaagcgaaactcgacaagggattaacgattggtggtcaactggctttcaaaggtacgacagcgttttcagccgttgctacgttcattgccgggatagcaggagccatcgagccggaaaacattgacggccagacggttaatcttaacaacctgaccatcatcaagtcagatgccggggcagttaaatactatatttgtccatcctctgcaggtggtgcaaatattaccaataagcctgacggcatagccggtaactttttgctccgtgtagagtcgactcgtaaggttagggattcagattatgcgaacatgcaaacgctgattaacagcgacacaaaacgtatatacgttcgctttgttgttaatggaaactggacagcgtggagtcaggttgttgtttccggatggaatcaggatataactgtcaggtcgttaaccacatctagtccggtaaaatctggcggagggcgaattgatgtccttggaagcacgtcagactatagcaaaatggattgctttgtacgtgggtttgatagcaccggtaattctctcgcgtgggcgttgggttcatcagccggcgtaagtaagatgctgtcgctaaaaaatttctttagcggagctgagatactgttaaatggtaatgacggcacggttcaactcaaaacaggtgctgttaacggggctacagcgcaggcgctcactatcaacaggaatgaggttaactcaactgttgatttaacccttacaaaacaatcagggactggcaatcgttttgttttacagaactcaggtaatgcagaactaccgttttctgtcagggtgtggggttccagtactcgacaaaacgtttttgaggttggcacgtctgctgcgtatctgttttatgcgcaaaaaacgtcagcaggccagttgtttgatgtaaatggcgctattaattgcacaacgctgaatcagtcatcagaccgcgaccttaaagacgatattctcgttatcagcgacgcgacgaaagcaatccgtaaaatgaacggatacacctacacgctcagggaaaacgggatgccttatgctggcgttattgcacaggaagtaatggaggcgataccagaagctgtgggatcgtttactcattatggtgaagagttgcaaggtccgaccgttgacggcaacgagctacgcgaagaaacgcgctatcttaatgttgactacgccgccgtgacgggcttacttgttcagttcgcccgtgaaacagatgatcgcgttaccgcgctggaagaggaaaacacaacgctacgtcaaaatctggcaacagcagacacccggatcagcactctggaaaatcaggtaagcgaactggttgcacttgtccggcagttaacaggaagcgaacattga

SEQ ID NO: 84 - DNA, 3762 bp, Artificial Sequence
  Synthetic: STF-62
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcaaactccgcgacagcagccaaaaaatcagaaaccaacgcgaaaaatagtgaggcagcagcaaaggtcagcgaaaccaacgctaaagcgtcagagaacaaggcgaaagaatatctcgacaaggtcgggggactcgtcagcccgatgacgcaatacgattggcctgttgttactgctagtgagtctctttacatcaagatcgcgaaactttccgatcctggaaccagcagaagtcatgtaacgctaatggttactaacgctggtaactacggctccccttacggaaacattgactttatcgagatctcggcgcgcggtctgccttctttgcttagtgcggataatgtttctcgtcatctgagtatacgccgcttagggtcaaccgggctgaccgataacaaccagatgcgttacggcctggttaaaggtgacggctttattgaggtttgggcattccagggtgcgtttattaacgacgcaaaggttgcggtgctggcgcagacaacactaaacacagaattatacattccagacggatttgttaagcaaaccgccgcgccttctggatatattgaaggcaacgttgtaaggatttacgaccaggtaaacaagccgactaaagcagatttgggtctttctaatgctatgcttacaggcgctttcggtcttggcggtagcgggatatcaacaaacggcaagatgagcgatgtagagatcttaaaagctctgcgtgacaaaggtggtcatttctggcgcggtgataagccgaccggaagcacggcgaccatttatagccacggttctggtatattctcgcggtgcggcgatacgtggtcagcgatcaatatcgactactcaaccgcgaagattaagatctatgccggcaacgatgcccggcttaacaacgggacttttagcgtcaatgagctatacggctcggcaaacaagccgtcgaaatcggatgttggacttggcaacgtaacgaacgatgcgcaggtgaaaaaatccggcgatgttatgtctggtgatcttgatatattgaaagaaacgccatctatcaggctaaaatcagcaaaaggaaccgctcatctgtggttcatgaacaacgacggaagcgagcgcggcgttgtttggtcgcctgaaaacaacgaatcacttggcgaaatccacatcagggcgaaaaacacaaaaggtgaatcaagtggtgattttattgttcgccacgacgggagggttgaggcccgcaatctaaaaataacttacaaaatcagcgcagccaccgcagaatttgcaaacacaagcaccagttccgataacactacggtaagcatcaaaggatctcagcatacgcctttggttttaacgagcaacaacacaattaaaaacttgtccattgggtttaaggttgatgatgttgatcaaaaatacctaggtatagctggtgacggtgatttgtattttggtagttattctgaccacacaaaaaacagcaaagtaatcacacaagcaaaactcgatagcggggtgacggtaggcggtaaaacaaccttttctgaccttgccacatttaacgcaggtatggcgggatctatcgagccggaaaccattgacaacaagactattgatttaaacgacttgatcattgctaatacagtggctggatctgttaaatactatcaatgcaaaactgtcgcaggtggtgcatatattaccaataagcctgacggcgtaagcggtaactttttgctacgtgtagaatctactcgtaaaactacgggttcagattatgcgatcatgcaaacgctgattggcagcgacacaaaacgcatatacgttcgctttgttgtcaatggaagttggacggagtggagtcaggtagttgtttcaggatggaatcaggatgtaaccgtcaggtcgttaacctcgacgactccatcaaaattaggcggcgggcgtgttgatgtgctggggagtacgtcagattacagtagtatgaattgtgctgtgcgcggtgttgatagcactggaaccaattcggcgtggtcagtaggtacatcgaaaaacacgggaaaaatgttgtgccttaaaaaccacagaagcagcgctcaagtgctgttaaatggcgatgatggcgcggtgcaactactaagcggtactgtcaacggtgctacagcacaggcgctaaccatcaacaaagatgaggttaactcaactgccgatttagtaattagaaaacaaacagggactggcaatcgttttgctttacttaattcaggtaattcagaactaccagttggtatcagggtgtggggttccagtactcgtcaaaacgtttttgaggttggaacgtctactgcgtatctgttttatgcgcaaaaaacgtcagcaggccagttgtttgatgtaaatggcgctattaattgcacaacgctgaatcagtcatcagaccgcgaccttaaagacgatattctcgttatcagcgacgcgacgaaagcaatccgtaaaatgaacggatacacctacacgctcagggaaaacgggatgccttatgctggcgttattgcacaggaagtaatggaggcgataccagaagctgtgggatcgtttactcattatggtgaagagttgcaaggtccgaccgttgacggcaacgagctacgcgaagaaacgcgctatcttaatgttgactacgccgccgtgacgggcttacttgttcagttcgcccgtgaaacagatgatcgcgttaccgcgctggaagaggaaaacacaacgctacgtcaaaatctggcaacagcagacacccggatcagcactctggaaaatcaggtaagcgaactggttgcacttgtccggcagttaacaggaagcgaacattga

SEQ ID NO: 85 - DNA, 2373 bp, Artificial Sequence
  Synthetic: STF-71
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcatcttctgccactgcatcagccaacagtcaaaaagctgcaaaaaccagtgaaaccaacgcaaaggcgagcgagactgcggcggctaactcggcgaaagcatccgctgcaagccagacggcagctaaagcaagtgaagatgcagccagagagtacgcaagccaggctgcggagccgtataaacaagttttgcagccgcttcccgatgtgtggataccgtttaacgattcactggatatgattacgggcttttcgccgtcatataaaaagattgttattggtgatgatgaaataacgatgtctggcgataaggttgtaaagtttaaacgcgcatcgaaagcaacctatattaataaatctggtgtgctgacagaggctgccattgacgagccacgatttgaacgtgatggcctgcttattgaggggcaaagaacaaactacatgctcaattcggaaagccctgccagttgggggcgatcgtcaaatatggatgtgcccgaaacagggacggataattttggttttacctatggaaagtttgtctgcaacgattctctgattgggcaaacctcagccattaatatggcatcaattgctgcaacaaagtcagttgatgtctcaggcgataataaacacgtgacaacctcatgtcgttttaaaacagaactgcaggtaaggttgcgtatccggtttgataaatatgacggtagcgcaacaacttttcttggtgatgcgtatattgatacacaaacgcttgaaattaatatgacaggcggtgctgcctcaaggattacagcgagagtcagaaaggacgaagctaccggatggatttttgcagaggcaacaattcaggcaattgatggggagttaaaaataggttctcagatacagtattctcctaagcagggcggggcaaccgtatctggtgactatatttatctggccaccccacaagtagaaaatgggccttgtgtatcatcttttattatatcaggaacgacggcggcgacccgcgcaagcgatatagtcacagttcccattaagaataatctttataatcttccttttacggttctttgtgaggtacataagaactggtataaaacgccaaatgcagcgccgcgtgtttttgacaccggcggtcatcaaaccggagcggcaattattcttggattcggttcttcagcagattacgacggatttccttattgcgatattggaggagctaacagacgggtaaacgaaaacgcattgcttgaaaaaatggttatggggatgcgtgtaaagtcagatcagtctacgtgctcagtaagtaacgggcgtatatccagcgaaacaaaaaccacatggtcctatattcagaacaccgcaattatccgtattggaggccaaactacagccgggttacgtcatttatttggtcatgtcaggaatttcagaatatggcacaaggcattgactgatgctcaggtgggggagtcaatctaa

SEQ ID NO: 86 - DNA, 282 bp, Artificial Sequence
  Synthetic: STF-71-AP1
atgaaagatttaacactcaaattagccgacagggccgacttttcggcctttatggagagtactggctattatgatgacgagtcgatgcaggatgatattcttattgacgtgataggtaacgtgtacaaagaaaccggagaactgaatgaagatggcgaaccggtatgtgttaaggaagacggatattttgtaaacgtgcgcatcattaatgatgtgaaaacaccgtcaatattcgatgaatacgtggttgctgttgagcatcaacttcgtggctggatgtga

SEQ ID NO: 87 - DNA, 3294 bp, Artificial Sequence
  Synthetic: STF-20
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgtctggcgaaaaatcagaacggtgcagatatccaggataaatcagcttttctggacaatattggtgttaccagcctgacgtttatgaaaaacaacggcgaaatgccggttgatgctgatctcaatacatttggtccagttaaggcttatgtgggtgtctggtataaatccacatcctccaacgcaacactggagaaaaatttccctgaagacggtgcagtcggtgttcttgaggtattcaatggcggtaatttttccggaatgcagcgttataccaccagaactggcaatgtttatatgcgtaatctttctggcacctggaatggctcagacggtccgtggatctactggcgtcagattcagtctgcaacacgccccctgagcacaactattgacctgaacacgctaggaggcgcagagcatcttggtttatggcgaaacagtagtggctctatcgcttcatttgaccgcaactatccggaagaaggaagttatggtcagggattccttgaagttcttgagggtggtgggtactcacgcacgcaacgctatacgacccgccgtgggaacgtatatgttcgctgcctttctgctatatggaatgcacagaacccacagtgggagccgtggtcaagagtaggccatcagtcagaatgtcgttattacgaaggtgatttgaatgatctgacttcgccaggcatttacagcgttacagggaaggcgtcaaacggtccaatgcaggataccgctggagcgacactgcttggaatactggaagtaatcaggcgttttgatggtgtatctgtctggcagcgttacacaaccacagggaaatcagaaaccacacaggggcgcacttttgagcgcgtctatgccgggagcaaatggaccgaatggcgagaagtatataactccttttcgttgcctctgaatctgggcatcggtggcgcagtggcaaaactatccagtctggactggcagacctacgattttgtgccgggcagtctgataaccgttcggcttgataatatgaccaacattcccgacggtatggactggggcgtcattgatggcaacctgataaacatctcagtcggtccgagtgatgattctggttcggggcgctcaatgcatgtatggcgcagcactgtaagtaaagccaactaccgcttttttatggtgcgcatttcaggaaatccgggaagccgcacgatcacaacaagacgagtaccaatcattgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactattggtggggcatcaacgttaattcttcattttaatatcggggaaggaagttgtcccgccgcccagtttcgcgttaattataagaacggtggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtg

SEQ ID NO: 88 - DNA, 525 bp, Artificial Sequence
  Synthetic: STF-20-AP1
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgatgagaataatataattgtcggcatcaccagagatgcttcaacgctcaaccctgaaggttttagcgttgtcgaggttcctgatattaccgccaaccgacgtgctgatgactcaggtaaatggatgtttaaggatggtgccgtgattaagcggatttatacggcagacgaacagctgcaactggcggaattacagaagtcagctttgctttccgaagctgaaactatcattcagccactggaacgctctgtcagactgaatatggcaacagatgatgagcgtagccgactggaagcatgggaacgctacagtgttctggtcagccgtgtggatcctgcaaatcctgaatggccggaaatgccgcaa

SEQ ID NO: 89 - DNA, 2274 bp, Artificial Sequence
  Synthetic: STF-23
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaagccccattaaacagcccggcgctgaccggaacgccaacaacaccaactgcgcgacagggaacgaataatacccaaatcgcaagcacggctttcgttatggctgcgattgccgcccttgtagattcgtcacctgatgcactgaacacgctgaacgagctggctgcggcgttgggcaacgacccgaattttgcgaccaccatgactaacgcgcttgcgggtaagcaaccgaaagatgccaccctgacggcgctggccgggcttgctactgcggcagacaggtttccgtattttacggggaatgatgtcgccagcctggcaaccctgacaaaagtcgggcgggatattcttgcgaaatcgaccgttgctgccgttatcgaatacctcggtttacgagaactcggcacaagcggggagaaaataccgttactcagtacagcgaatacctggaccaatcgacaaacattcagcggtggcctttctgggggactgtccggcaatgccgctactgcaacaaagctgaaaacagcacgaaaaattgctggagttggttttgatggttctagcgatatttcaattagtgccaaaaatgtcaatgcatttgcactccgacaaacaggtaatactgttaatggtgatacatccgttggatggaattgggatagtggtgcatataacgccctgattggtggtgcatctgcattaattcttcactttaatataaatgctggtagctgtcctgccgtacaattccgtgtgaattataaaaatggtggcatttcctacaggtcggctcgtgatggttatgggtttgaattaggttggtcagatttctataccacgacacgaaaaccttcagcgggagatgttggtgcatatacgcgggcagaatgtaactcaaggtttattacaggtattcgccttggcggtctgtcatctgttcagacatggaatggtcccggctggtctgacaggtcaggttatgtcgttacgggttcagttaacggaaaccgtgatgaattaattgatacaacacaggcaaggccaattcagtattgcattaatgggacgtggtataacgcggggagtatttaa

SEQ ID NO: 90 - DNA, 531 bp, Artificial Sequence
  Synthetic: STF-23-AP1
atgatgcacttaaaaaacattactgctggcaaccctaaaacaaaagagcaataccagctaacaaagcaatttaacatcaaatggctttattcagatgatggaaaaaactggtatgaggaacaaaagaatttccagccagacactttgaaaatggtctatgaccataacggcgttattatttgtattgaaaaggatgtttcagcaattaatccggaaggcgcaagcgtcgttgaattacctgatattacagcaaatcgccgggctgatatttcggggaaatggttgttcaaagatggcgtagtgataaagcgaacttataccgaggaagagcagaggcaacaagcggaaaatgaaaagcaaagcctgttgcaacttgtcagggataaaacccagctatgggactcacagctacggctgggcatcatttccgacgagaataaacaaaaattaaccgagtggatgctctatgcgcagaaagtcgaatctacagacacctccagcctgccagtaacgtttcccgaacaaccagaa

SEQ ID NO: 91 - DNA, 2136 bp, Artificial Sequence
  Synthetic: STF-24
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgtcttcagaaagatcagaacggtgcggatattcctgataaaagattattcctgcgcaatattggagcaacaaattcaacaaccatgtcttttagtggtggtacaggatggttcaggctggcaactgtaaccatgccccaggccagttccgtggtttacataagcctgattggtggtgccggatataatgttaactcccctatgcaggctggtatatctgaacttgttcttcgtgcgggaaatggaaatccaaaaggtcttactggtgcgttatggcgacggacatcggttggatttactaattttgcatgggtgaatacatccggtgatacctatgatgtttatgttgaaataggtaattacgccacaggtgttaatattcagtgggattataccagtaacgccagcgtaacgattcatacatcaccaacttatacagcgaataaaccaacaggcctgacagatggaactgtatatgtaatttacagttcgtacattaaaccgactgctgctgatgttggggcgttatcattatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtg

SEQ ID NO: 92 - DNA, 528 bp, Artificial Sequence
  Synthetic: STF-24-AP1
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgatgagaataatataattgtcggcatcaccagagatgcttcaacgctcaaccctgaaggttttagcgttgtcgaggttcctgatattaccgccaaccgacgtgctgatgactcaggtaaatggatgtttaaggatggtgccgtgattaagcggatttatacggcagacgaacagctgcaactggcggaattacagaagtcagctttgctttccgaagctgaaactatcattcagccactggaacgctctgtcagactgaatatggcaacagatgaggagcgtagccgactggaagcatgggaacgctacagtgttctggtcagccgtgtggatcctgcaaatcctgaatggccggaaatgccgcaataa

SEQ ID NO: 93 - DNA, 2523 bp, Artificial Sequence
  Synthetic: O111-2.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggctcctctgaactctccggccctgactggcacgcctactactccgactgcgccgcaagggaccaactctacccagattgcgtccacggcattcgttatggctgctattgcagcactggtagattcctcgccggacgctctgaacactctgtcggaactggcggctgcactcggaaatgatccgaacttcgccaccaccatgactaacgctctggccggcaaacagccgaaagatgctaccctgaccgccctggcaggtctcgtgaccgctgcggaccgcttcccgtatttcacaggcaatgacgttgcctccctggctaccctgaccgaggttggtcgtgacatcctggcgaagtctaccgttgcggccgtgattgaatatctgggtctgcaggaaactgttaaccaggcatcaggtgcattacagaagaatcaaaacggtgcagacattccgggcaaagatacctttaccaagaatatcggtgcttgtcgtgcttattcggcatggcttaatatcggaggtgattctcaggtatggactacggctcagtttatctcttggctcgagagtcagggtgcgtttaatcatccgtactggatgtgcaaaggctcttgggcgtacgcgaacaacaaagtcatcaccgacactggttgtggtaacatctgtctggcgggtgcagtagtggaagttatcggtacgcgcggtgcgatgacgatccgtgtaactactccatctacctcctccggtggcggtatcaccaacgcccagttcacttacattaaccacggcgatgcctatgctccgggctggcgccgtgattacaacactaaaaaccaacaacctgcgtttgcactgggtcagacgggtagtcgtgtggcgaacgataaagcggtcggttggaattggaactctggtgtgtacaacgctgatattagtggagcttctactctgatccttcattttaacatgaatgctggaagttgtccggcagtgcagtttcgtgttaactatcgtaatggaggaatcttttaccgctctgcacgtgacggctacggcttcgaagcgaactggagtgaattttacacgaccactcgtaagccgagtgctggagatgtgggagcttatactcaggcagaatgcaattcgcgtttcattactggtattcgtctgggaggtttaagttccgtgcagacttggaacggtccaggttggagtgatcgtagtggctatgttgtgacaggcagtgttaacggcaaccgtgacgaactgatcgacactactcaagcgcgtccgatccagtactgcattaacggaacttggtataacgcgggaagtatctaa

SEQ ID NO: 94 - DNA, 534 bp, Artificial Sequence
  Synthetic: O111-2.0-AP1
atgatgcacttaaaaaacattactgctggcaaccctaaaacaaaagagcaataccagctaacgaaacaatttaacatcaaatggctttattcagaggatggaaaaaactggtatgaggaacaaaagaatttccagccagacactttgaaaatggtttatgaccataacggcgttattatttgtattgaaaaggatgtttcagcaattaatccggaaggcgcaagcgtcgttgaattacctgatattacagcaaatcgccgtgctgacatttcgggtaaatggatgttcaaagatggcgtagtggtaaagcgtacttacacagaagaagagcaacgtcaacaggcggaaaatgaaaagcaaagcctgctacagctcgtcagggataaaacccagctatgggacagtcagctacggctgggcatcatttccgacgagaataaacaaaaattaacagagtggatgctctttgcgcagaaagtcgaatctacagacacttccagcctgccagtaacgtttcccgaacaaccagaatga

SEQ ID NO: 95 - DNA, 2265 bp, Artificial Sequence
  Synthetic: STF-74
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatatacggctcaggacgcgagcacggcgcagaaaggtctggtgaaactgagcagcgccaccgacagcacatctgagaccctcgccgcgacaccgaaagcggttaaggcggtgaatgataatgcgaatggtcgcgtcccgtctgagcgaaaagttaacggacattcgctggccggtgatatcagtgtcacctcacaggatatttttgacggtcagtgtgttgaaattggtccgggtcaggatctggataattaccagacgccgggtctgtattttcagcccgcaaatgccaataccagtgctgctctgcattacccggaaaataatgccggttccctgatggttttaagaagcgcagggataacgcaggtttatcgcgtgtacagcggttcgcgaagttatttgcggagcaaatattccacgcagccatggacgacgtggacacccgatgatgcttttcctgtcggcgcgccgattccgtggccatctgacatcgccccgcccgcttacgccttaatgcaggggcagtcatttgataaatctgcatatccattgcttgctgtagcgtatccctctggtgttatcccggatatgcgtggtcagacgataaagggcaagccggacggacgagcggtactctcgtatgaacaggacggtattaaatcgcacgctcatacagccagtatttccgataccgatttgggaacgaaatataccaactcttttgattatggttcaaaaccaacaaccagttttgactacggcaataagtcctccactgaggggggatggcacgtacataactttcgttattgtgctacgtctgcataccgggatactcctggctcagggctggggatgcactcgtcgaatatttcgtggtcagccggggatcgcattgaggggagtggtaatcatgcacatgttacgtggattggtccccatgatcactgggttggtatcggtgagcataaccattatgtggttatggggtatcacggacatacagcgaccgttcatgcaaccgggaatacagaaaacaccgttaaaaatattgcgtttaactacattgtgaggcttgcataa

SEQ ID NO: 96 - DNA, 579 bp, Artificial Sequence
  Synthetic: STF-74-AP1
atggcttttgaaatgaccggagaaaaccggacaattattctttataaccttcgttcagatacaaatgaatttattgggaaatctgatgggtttatccctgctaatacgggcttgcctgcttacagtaccgatatcgcgcccccaaaagtgacggcaggttttgtggctgttttcgatgcacagacgaataaatggtcgcgggtggaggactaccgcgggacaaccgtctatgacatcagcaccggtaagcccgctgttattgaaaaacttggcgctctgcctgataacgttgtgtcggttgctcctgacggggagtatgtaaaatgggatggcgctaagtggatccacgatgccgaagcggaaaaaacatttcgtcaggggcaggcggcgcaggaaaaatcaaacctgctgatgattgcaacatcggctattgcccccctgcaggatgccgttgatctggatatggcaacggaagacgaagcgaccgcgcttaatgaatggaaaaaataccgggtcatgctcaacagagtcaaacccgaagatgcccccgatatcacatggccggaactgcccgcataa

SEQ ID NO: 97 - DNA, 2133 bp, Artificial Sequence
  Synthetic: STF86
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgcgttccggcatcacgaaaagtgaacggccatgccctgaatggagatatcaatgtcacttcacgggatatttttgacggccaggttatagcgattggtgcaaataagaatctggatgattaccaggtaccggggctttattttcaggaagcgaacaacaataccagtgcagcaatgaattacccggagaatagcgcgggttctctgatggtactgagaggtgccggagtcactcaggtttatcgtgtgtacaacagctcgcgcagttattcgcgcagcaagtattcaacgctggcatggacgccgtggatgccagaagattcttaccctgtcggcgcacctatcccctggccatcggatgttaccccgacagggtacgccttaatgcaggggcagccctttgataaagcggtctatccattgctagcgattgcctatcctgcggggattatcccggacatgcgaggccagacgattaagggtaaaccgaacggtcgcgcggtactctcgtatgaacaggatggtgttatatcgcatacccacggagccagtatttccgataccgatttggggacgaaatacaccagctcttttgattatggttcaaaaccaacaaccagttttgactacggcaataaatcctccactgagggtgggtggcacgcacataactttcgttattgcgcaacgtctgcataccgggatacccccggtcaggggctggggatgcattcgtctaatgtttcatgggcggcgggagatcgcattgagggaagcggtaatcatgctcatgtgacatggatcggccctcatgatcactgggtgggtattggtgcgcataaccattatgtggttatgggctatcacggacatacagcgaccgttcatgccgcaggaaatgcggaaaataccgttaaaaatattgcgtttaactacattgtgaggcttgcctga

SEQ ID NO: 98 - DNA, 588 bp, Artificial Sequence
  Synthetic: STF86-AP1
atgacttttgaaatgaccggagaaaaccggacaattaccatctataacctgcgtgctgatacaaatgaatttatcgggaaaagtgatgggtttatccctgctaataccggtttgcctgctaacagtaccaatattgcgccaccgccgatgaaagccggttttgtcgctgtatttaattctgcgtcagaaaaatggtcacttgttgaagaccatcgcgggaaaattgtttacgacattctcaccgggaaatccatcacgattgatgaattaggtcagttacctgacgacgttgtttccgttgcgccggaaggccattttgttaaatggaatggtaaaaaatgggtgcatgatgctgacgcagaaaaaacggcacagattacacaggctacacagcaaaaagacagtcttctggcgctggctgcatcaaaaattgccccattacaggatgctgttgatctggatattgcaacggaagaggaaacagcgcttttgctggcgtggaaaaaatacagggttttgattaatcgtattaagccagaagatgcgccagatattgactggccggaggttccgggcgatgtggcgtga

SEQ ID NO: 99 - DNA, 2592 bp, Artificial Sequence
  Synthetic: STF84
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatacaccgcacaggatgcaacgacagcacagaaagggatagttcagcttagcaacgcgaccaacagcacatctgaaatgctggcggcaacgccaaagtcggtaaaggcagcctatgaccttgctaacgggaaatatactgctcaggacgctacgacagcacaaaaaggaattgtccagctcagtagtgcaaccaacagcgcatctgaaacgcttgccgcgacaccgaaagcagctaatgataatgcgaatggtcgggtaccttctgcccgtaaggtgaatggtaaggcgctttcagcggatataacactgacgccgaaagatattggtacgcttaactcaacaacaatgtcattcagcggtggtgctggttggttcaaattagcaacggtaaccatgccacaggcgagttctgttgtttcaattacgttgattggtggcgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagggcagttttatccgcctggcgcaccaatcccgtggccatcagataccgttccgtctggttatgccctgatgcaggggcagacttttgacaaatctgcttacccgaaactcgcagccgcttatccgtcaggcgtgatccctgatatgcgtggctggacgattaagggcaaacctgccagtggtcgtgccgtattgtctcaggaacaggacggcattaaatcgcacacccacagcgccagcgcatccagtacggatttggggacgaaaaccacatcgtcgtttgattacggcactaaatccacgaataacaccggggcgcatacgcacagtgtgagcggtacagccgcaagtgccggaaaccatactcatagtgtcacaggcgcatcagcagtcagccagtggtcacaaaatgggtcagtacataaggtagtgtctgcggccagtgtgaatacaagtgctgcaggagcgcacactcatagtgtcagcggcacagccgcatctgcaggtgctcacgcacatactgtcggtattggtgctcatacgcactctgttgcgattggctcacatggacacaccatcaccgttaacgctgctggtaacgcggaaaacaccgtcaaaaacatcgcatttaactacattgtgaggcttgcataa

SEQ ID NO: 100 - DNA, 585 bp, Artificial Sequence
  Synthetic: STF84-AP1
atggcattcagaatgagtgaacaaccacggaccataaaaatttataatctgctggccggaactaatgaatttattggtgaaggtgacgcatatattccgcctcatacaggtctgccagcaaacagtacctatattgcaccgccagatattcctgctggctttgtggccgttttcaacagtgatgagggatcgtggcatctcgttgaagaccatcggggaaaaaccgtctatgacgtggcttccggcgacgcgttatttatttctgaacttggcccattaccggaaaatgtcacctggttatccccggaaggggagtttcagaagtggaacggcacagcctgggtgaaagatgcagaagcagaaaaactgttccggatccgggaggcggaagaaacaaaaaacagcctgatgcaggtagccagtgagcatattgcgccacttcaggatgctgtagatctggaaatcgcaacggaggaagaaacctcattgctggaagcctggaaaaagtatcgggtgttgctgaaccgtgttgatacatcaactgcacctgatattgagtggcctacgaaccctgtcagggagtaa

SEQ ID NO: 101 - DNA, 3849 bp, Artificial Sequence
  Synthetic: STF-93
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtagggtgccatctaaccgaaaagttaacggtaaagcactgactgcggatatcacattaacgccgaaagatattggtactttaaattcagtaacgatgtctttctctggcggggctgggtggttcaaactggctacggttaccatgccacaagcgagttccatcgtttacatcgcattgattggtggcgctggttacaacgtcggctccccacatcaggcaggcatttcagaactggttctacgagcaggcaatggaaaccccaaagggattaccggtgctttgtggaagcgtacagccgtcggattaacgaatttcgcctggatcaacacatccggcgatacatatgatatttacgttgagattggcaattatgcgactagtgtaaatatccattgggattgtactgcaaatgcgacagtttctatttatacatcgccaacatattcagcgagtaagccttccagcgttaccgatggtgttgtttatacgatgtatagcacacatcagaaaccgacgccgttagatattggagcactgccaacaaccggaggaacagtttcaggtccgttgtctgttactggtgggatcaccggaacattaaatggtaatgcaagtacagcaacgaaattgcagacggcaagatctatcggtggagttggtttcgacggttctgcaaatatcaaccttccaggtgtaaatactacgggtaatcagaacaccactggtaatgctgcaactgctacaaaacttcagacggcaagaactatcggcggcgtgagctttgatggtactgcgaatattaatttgccaggtgttaatacgactggtaatcagaatacaacgggcaacgcggctactgctacgaagttgcagactgcgcgtactatcaatggggtgtcgtttgacggctcggcaaatatttccttgtcgccagcaaatataggttgcccggcatctcctactggttggttaactacaggaagtaatggcggagcaataacaacagcacagttagtgacgttattgcaaaataatggagcatttaacacaaagtcatggattgctcgatgtgcgtgggcctatgccaatagtgcaaccataccaaatagtgaaactggttgtggcgttattccattggcaggagctgttatagaggtatttaataacggtagtagctcaaacaattatacgatccgtataacaacggccacaacgacgagtgtctctggtgctctcactaatgcggagtttatctatgtatttaatggcacagattattctccgggatggcgaagagtatataacacgaaaaacaaaccaacagcctctgatgtcggtgcattacctcttaccggtggtacattatctggaggtttgacatcttctggcgagatcatttcaaaatatgcaaatggtttccgcattgcttacggtagctttgggttctttatccgtaatgatggatcgaacacatatttcatgctaacagcatcaggagacacattaggttcatggaacggtttgcgacctattacaattaataataccagcggtgcggtatcaattggtaatggactaaatgtgactggtggcgtaaatggtagtttgaacggtaatgcttcaacagctacgaagttgcaaacagcgagaaacatcaatggtgttaagtttgatggctcaggcgatatcaacattaatacactggtatctcgtggccgagttacggcattaagcggctctactcaaggcactgctggcattcaaatgtacgaggcgtacaacaatagctacccgaccacgtatggcaacgtattgcacatgaaaggtgcgagtgctgctggtgagggcgagttgcttattggctggagtggtacgagcggtgcacatgcgccagttttcattcgctcacgaagagataccacagatgcggcatggtcagcgtgggcgcagctatatactgctaaggattcaatccctggtgtgaatacaaccggtaatcagaatactactggtaatgccgcaacagccacaaaattgcagacagcaaggaaaattgctggtgtggcgtttgatggctctgccgatattactttgactgcggctaaccttaatgcttatacgaaaacagaggtaacaaaccttctaagttcctatgcaagcagatcatcactgacaggctatagtggcaacctggatattattgctgaaacactggttgtcaaatcaggcggtagtggagggtttgctatatgggatattggcacaactactagcggtgccaatatgtacattgatccaaaccctggtatcaatacagtttggcgttcaacatcttcaaggcgctataaaaaggatattgaaacattacaagatcgatatgctgatgaacttttgtcattaagacctgtttggtatcgttcaatttgtcgaggtgaccgaaaggattgggggtattacggccttattgctgaagaggttggtgagattgccccgcaatatgtccattggcgtgaaccaacaaataatgattctccagaagatatttcctcaaatggtatggtcgctgaaggggtgatgtatgagcgtttggttgtaccactcattcatcatattcagcaattgaccaaaagggttgaggagcttgaaacgaagttaaattcacctaaagaa

SEQ ID NO: 102 - DNA, 2397 bp, Artificial Sequence
  Synthetic: STF-95
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtcgggtaccttctgcccgtaaggtgaatggtaaggcgctttcagcggatataacactgacgccgaaagatattggtacgcttaactcaacaacaatgtcattcagcggtggtgctggttggttcaaattagcaacggtaaccatgccacaggcgagttctgttgtttcaattacgttgattggtggtgcgggatttaacgtggggtcacctcaacaggcaggtatatctgaacttgttttgcgtgcaggtaatggtaatccgaaggggattactggtgctttatggcagcgcacatcgacagggtttacaaattttgcctgggtcaatacatctggtgatacttacgatatttacgttgcaatcggaaattatgcgactggtgtaaatattcaatgggattataccagtaatgccagcgtgacgattcatacgtcaccagcatattctgctaataagccggaagggttaacggacggtacagtttattcactctatacgccatcagagcagttttatccgcctggcgcaccaatcccgtggccatcagataccgttccgtctggctatgccctgatgcaggggcagacttttgacaaatctgcatacccgaaacttgcagccgcttatccgtcaggcgtgatccctgatatgcgtggctggacgattaagggcaaacccgccagtggtcgtgccgtattgtctcaggaacaggacggcattaaatcgcacacccacagcgccagcgcatccagtacggatttggggacgaaaaacacatcgtcgtttgattacggaaccaaatccacgaataacaccggggcgcatacgcacagtctgagtggctctacggggtctgccggtgatcatactcatggtaatggtattcgttggccaggaggcggcggttctgcgttagcattttatgatggcggtgggttcacttatgtccaggattcacagtatcaagtaagcccggggacttcttcccgtagatcgtattatcaacgtattcagacacagtcagcaggtgctcatacccactcgctgtctggtactgcagcaagttctggcgcacatgcacatactgtaggtattggtgcgcatacgcactccgttgcgattggttcacatggacacaccatcaccgttaacgctgctggtaacgcggaaaacaccgtcaaaaacatcgcatttaactatattgtgaggcttgcataa

SEQ ID NO: 103 - DNA, 585 bp, Artificial Sequence
  Synthetic: STF-95-AP1
atggcattcagaatgagtgaacaagcacggaccataaaaatttataatctgctggccggaactaatgaatttattggtgaaggtgacgcatatattccgcctcatacaggtctgccagcaaacagtaccgatattgcaccaccagatattcctgctggctttgtggctgttttcaacagtgatgaggcatcgtggcatctcgttgaagaccatcggggtaaaacggtttatgacgtagcgtcaggggacgagttatttatttctgaactcggtccgttaccggaaaatgttacctggttatcgccggaaggggagtttcagaagtggaacggcacagcctgggtgaaggatacggaagcagaaaaaatgttccggatccgggaggcggaagaaacaaaaaacaacctgatgcaggtagccagtgagcatattgcgccgcttcaggatgctgcagatctggaaattgcaacggaggaagaaacctcattgctggaagcctggaaaaagtatcgggtgttgctgaaccgtgttgatacatcaactgcacctgatattgagtggcctacgaaccctgtcagggagtaa

SEQ ID NO: 104 - DNA, 1878 bp, Artificial Sequence
  Synthetic: STF-132
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgccgttcagcgtgatggtgacaccatgaccggggaactgaaaatccgtggtgttaatgcgctgaggattttcaacgacgcctttggtctgatttttcgtcgttcagaagagtgcctgcaccttatccctaccagtgaaggtcagggcgagaatggcgatattggtccacttcgcccgttcactattaatctgcggacgggtgaaatatccatgtcgcataaagtgtctgttggcggcggttctcaggtcaatggtgcgctgggtatcggcgttcagaacgcgctgggcggaaactcaattgctttcggggataacgatacaggtataaaacaaaacggcgacggcattctggatgtttatgcgaatggacagcacgtattccgttttcagaatggcgcgttacaaagtcaccgggcagtgaatgtttcagggcgggtaacaccaactgattatggcaatttcgatgaacgctaccagaccaaaacaggcggcgtgcagaattttcagtacaccagtgaggtgtttcacaagccagccggtaatgaggtttcctgggtttttcgggcgccgtcaggttgcactctttctgggattaatgtgcaggagaccggtagtaactctgcggataatatcggtggtgtgtattacaaacaggcccagatttatataaatggcgcatggcgctcagtatcaggttaa

SEQ ID NO: 105 - DNA, 567 bp, Artificial Sequence
  Synthetic: STF-132-AP1
atggcgctcagtatcaggttaattaaggcaaaaataatggaactcagaaatgtcacgcgttattacccggaaaacatgccttatggtgaaggtgttcagtatttccgtagtgaagacgggcaggatttttatgaatcactggataaattcgcgaagaaatacaagctgtgcacgcatcctgaaaccggtgttatttattcaatggcggaagacgtatcccggctttatccggcaggtttcaccattgtggaagtggatgaactaccggatggcttttgtatagaggcgcgctggtattataaagacggtgaagtactgccggttcctgttgattacagactgctggctgagtcggaacgagcacgtcttacggcgattgctgaacgggaaatatccgacaagaaaacagatttacttctgggaataattaataatggggaaaaagaaatgctgaaattatggcggatgtacatcagaaatttaaagaatattgattttaatcacattcatgataaatcgtcatttgatagtattaaatggccttgtgatcctgagaattcacattaa

SEQ ID NO: 106 - DNA, 4023 bp, Artificial Sequence
  Synthetic: K1F
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggtgcgaagggcgatggcgttaccgacgacactgcagcgctgacttccgccctgaacgatactccggtgggtcagaaaatcaacggtaacggtaaaacttataaagttacgtccctgccggacatctcccgctttatcaacacccgtttcgtgtatgaacgtatcccaggccagccgctgtactacgcatcggaagagttcgttcagggtgagctttttaaaatcaccgacactccgtattataacgcctggccacaggataaggctttcgtgtacgaaaacgttatctatgctccgtacatgggttccgaccgtcacggtgtcagccgactgcacgtaagctgggtgaaatcgggcgacgatggtcagacctggagcacgcctgagtggctgaccgaccttcatccggactatccgaccgttaactatcactgcatgagcatgggcgtctgtcgcaaccgtctgttcgcaatgatcgaaacccgtacgctggcaaaaaacgctctgactaactgcgccctgtgggatcgtccaatgagccgctctctgcacctgacgggtggtattaccaaagcagcgaaccagcgttacgccaccattcacgtaccggatcatggtctgttcgttggtgactttgtaaatttctctaattctgcagttaccggtgtgtctggcgacatgaccgttgcgaccgtaatcgataaggacaatttcaccgtcctgaccccgaaccagcaaacctctgatcttaacaacgctggcaagaactggcacatgggcactagctttcacaaatctccgtggcgtaaaaccgatctgggcctgatcccgtctgtaactgaagtgcactccttcgcgaccattgataacaacggtttcgctatgggttatcaccaaggtgatgttgcaccgcgtgaagtcggcctcttttattttccggacgcattcaacagcccgtccaactacgtgcgccgtcagattccgtctgaatatgaaccggacgcctccgagccgtgcattaagtactatgacggtgtgctgtacctgattacccgtggcacccgtggtgatcgtctgggttcatctctgcatcgctcccgcgacattggtcagacgtgggaaagtctgcgcttcccgcacaatgttcatcacaccaccctgccgttcgcgaaagtcggcgatgacctgatcatgtttggctccgaacgtgctgaaaacgaatgggaagcgggcgccccagacgatcgctacaaggcatcttacccgcgcaccttctacgcgcgtctgaacgtgaacaactggaacgcagacgatatcgaatgggtaaacatcaccgaccagatctaccagggtggtatcgtgaactctggtgtgggcgttggttccgttgtagttaaagataactacatctattatatgttcggcggcgaagaccacttcaacccgtggacttacggcgataactccgcgaaagacccgttcaaatccgatggtcacccttctgacctctattgttacaaaatgaaaatcggtccggacaaccgtgtttcccgcgattttcgctacggcgctgttccaaaccgtgcagttccggtattcttcgacacgaacggcgtgcgtaccgttccggctccgatggaattcaccggcgacctgggtctgggccacgtaaccattcgtgcctccaccagctctaacatccgttccgaagtactcatggaaggtgaatacggctttatcggtaagtctatcccgacggacaacccggcaggtcagcgtatcatcttctgcggcggtgagggtacctctagcaccaccggcgcgcaaatcaccctgtacggcgctaacaacaccgactctcgtcgtatcgtatacaacggtgatgaacatctgttccagtccgcagacgtgaaaccgtacaacgacaacgtcaccgcactgggtggtccatccaaccgtttcaccactgcgtacctgggttccaacccgatcgttactagcaatggtgaacgcaaaactgaaccggtagtgtttgacgacgcttttctggacgcatggggcgatgttcattacatcatgtatcagtggctggatgccgtgcagctgaaaggtaacgacgcgcgtatccactttggtgtgatcgcacagcagattcgcgatgtcttcatcgcacacggtctgatggatgaaaatagtactaactgtcgctatgcggtgctgtgctatgacaaatacccgcgtatgaccgacaccgtgttctcgcacaatgagattgttgaacataccgatgaagaaggtaacgtgactactaccgaagaaccggtttataccgaagtggttattcacgaagaaggtgaagaatggggcgtgcgtcctgatggtatctttttcgcggaggcagcgtaccagcgtcgcaaactggaacgcatcgaagctcgtctgtcggcactggaacagaaa

SEQ ID NO: 107 - DNA, 3462 bp, Artificial Sequence
  Synthetic: K5
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcctaaaaccgaaggtatcctccataaaggtcagagcttatacgaatatctggatgcccgtgttcttacttctaagccattcggtgcagcgggtgatgcaacgaccgacgacacggaggttatcgctgcgagcctgaacagccagaaagctgttaccatctctgacggcgttttcagttcttctggcatcaactccaactactgtaacctggatggtcgcggatccggtgtgctcagccaccgtagctctactggtaattacctggtgtttaacaatccgcgtactggtcgtctgagcaatatcactgttgaatctaacaaagcgaccgataccactcagggccaacaggtgtccctggcaggtggcagtgacgtgaccgtgtcagatgtcaacttctccaacgtgaaaggcactggttttagcctgattgcctacccaaacgatgctccgccggatggcctgatgatcaaaggcattcgcggatcttacagcggttacgcgaccaacaaagcagctggttgcgtcctggcggatagctccgttaacagcctgatcgacaatgtgatcgctaagaattacccgcaattcggtgctgttgaattaaagggcactgcaagctacaacattgtatcgaacgttatcggtgcggattgtcagcacgtgacttacaacggcactgagggaccgatcgctcctagtaacaatctgatcaagggcgttatggcgaacaacccgaaatacgcggcagttgtggcgggtaaaggctcgacgaatctgatctctgatgtactggtagactattctaccagcgatgctcgtcaggcgcatggtgttaccgtcgaaggatctgataacgtgattaacaacgtactgatgtccggttgcgacggaactaattccctgggtcagcgtcaaaccgcaactatcgcgcgtttcatcggtactgcaaataacaactatgctagcgtgttcccatcctattctgccactggtgtgatcacgtttgagtctggcagtacccgtaacttcgtcgaggttaagcatccgggccgtcgcaacgatcttctgtcatcggcaagcacgattgacggcgctgcgaccatcgacgggacttctaactctaacgtagtacacgcgcctgctctgggccaatacattggctccatgagtggtcgctttgaatggcgtattaagtcaatgagcctgccgtccggcgtactcactagcgcggataaataccgtatgctgggtgacggtgctgttagccttgctgttggcggaggaactagcagtcaggtgcgcttgttcacctcagacggtacttctcgcactgtttctctgaccaatggtaacgtgcgcctgagcacgtcctctactggctatttacagctgggtgcagacgcaatgactccggactccactggtacttacgcgttaggctccgcatctcgtgcttggagtggcggattcactcaggcagcattcaccgttacttctgacgcacgttgcaaaactgagcctttaaccatctctgacgctttactggatgcttggagtgaagtggactttgtccagttccagtatctggatcgtgttgaagagaaaggtgctgactccgcgcgttggcatttcggaatcatcgcccagcgtgctaaagaggcattcgaacgtcacggcatcgatgcgcatcgttacggtttcttatgctttgactcttgggacgatgtgtacgaagaggatgcaaatggatctcgcaaactgatcactccggcgggtagtcgctatggtattcgctatgaggaagttctgatcctcgaagcagcgctgatgcgtcgcacgatcaagcgcatgcaggaagcactggctgcgttaccgaag

SEQ ID NO: 108 - DNA, 3225 bp, Artificial Sequence
  Synthetic: STF-37
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggagttatctggagagcacgggtcgtttttgattggcggagtaattgattgttactcaaccgtttcagatcttatttcttcctccccatccgttggtagagtatgcaggactatagggtattacagcccaggtgatggaggtggggcagattacataattagtattggaactccgatgcaagattttagcgattctggttctatagttatagatgaatgcaagttcgctaaattaatccagcaaagccaatatgatttaaagcagtttggagtaaaaccatctgacccgtcttatgcagaaaaaaacgacatatttatctcgcaagccattactaggtctagagttggaagatgcaagattattataagcgatgttatatatcataaaaaacctttaatttttgattattacaatcatatggaaggaagttgtattggtagtgacccggaatttactcctaggtttataaaaatagataatacaactagcggtttgccagatatgggataccctggtgttgctgatgttgtatcttacgatgttgatgcaggaataataattaaaagacagaattctggcacaagttttgccagaggtttcataattaaggggtttcttcttcagtcggagaagaaatcagcatgggcaatttacgcgccgcatatggcggattttgatatagacattgatagtcgtgggtttaatggaggaatcagatggtttgttaattttcttggaagaatggcaggaagacatataggtcttggtgcaaactcatcagatccaacattatctataggtgcgtggtgttcgaaattctctacaatacctgattgtggtaattccgttgtattcagattgtcattcaatggatttaacagaggtatgcaaatggagtattttggtaatggggttttagatagagtaactcttgaaaatatttcaaaaccaacacctacgtcgccaacaacacatggaatatatgcaactgatacatggttaactggccaggtgtcatgtgaaagttcttcaacctgcatcatccgtgctggcaataacgcgaacttcgatattacccttagtgcggtattccatgttacgcaagatgatccttccgagggtattgttcatgtattaaatggaggccgcctaactctgcgttcatctacaattcttgctgatttggcagatacaaaaatcattaatgagaatggaggttatctcgatattgccgcaaataccagaacaggaaatattgtttattccaatagtgataattacagattcaaagacagaaccattggttttggtcagactgcggcaactacaaaaacaagcttctcttctggtgaagagattacattttcactactaaacggaacgccaaaagcgaatctatctggcggaacgatccagtttaactctccatgcctgattaaaatcactgtgcaggggaggggtataacatcaggagcacttacttttgggataaatggagaatcttcagagagcgtgagtcagggacagcaggtttctatggttgtcggagtggtatccggtgacattcttaacctgaaggcaacctcatcactgacgctgggtagtgcaggaggggtgcgggtacttcttgagcctgtaaac

SEQ ID NO: 109 - DNA, 2865 bp, Artificial Sequence
  Synthetic: 1JL
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggctacaaagttcagagcttagcaattctgtccgacacccaagctgtccacgatgctactaacaccattaaaacccagacggacaagatcaaggcagacacgcaggcaatcaaaactcaaacaaatcaaattaaaaccgaaacgggcgtaattcgtgataaagcgaacactgcgaaaactgatgcgcaggccgcgagcgccgccgcacaaggcttccgtgatcaggcgaaggagtgggcacaaagtgtaaacgctgataacttattaaccaaaacgggcaacttagctggcctgactgacaagagcgcggcacgttctaatttagggctaggaagcgtagcaacggaaaacaccgttccaattaagaaaggcggcactgcggcaacgaccgtcgcggcggcacgctccaatttagggctgggtagcgttgcaacggagaacactgtcccaattgaaaagggggggactgcggcgacaaccgccgcgaaagcgcgtagcaatctgggtttaggtagcgtagctacggagaataccgtgccgattgaaaagggcggcacggcggcgaccactgccgctaaagcccgttcgaacttcggcttaggcgataacaacaaagtaaaacttggtacactgcgcctgaacgggggtgaatctctggttttcaacgatgtggaacgcaatggcctgattatcagcaacgccagcttcggtatcgatagctgggttggtcaaaccatgcacaaatggtataccgattggacgcgtgctggcttagtgcgtgcaggtgacgcgcatctgagcgattatcgtgtgcatgtttggaaagacggtttcaccgaagccctgtttcgtttcctgccggacgggcgcttgatttccggcaactccggtaatccgtctgttaacgaatttcaaaaagccccgctgtctgatcgtgacctgaaaaaagaaatcaagtacactgatggcgaagaatcctataaccgtgttcgccaatggcttccggctatgttcaaatacaaagagagcgacgttcagcgttacggcctgattgcacaagatctggcacgtattgatccggaatacgttcacttattaccgggctatgcaatctacgaagacgttaagggtgtagacgaagagggcaatgaggttgttgtggatcgtaaagagatcggctataccgacgatgtgttatctctggattctaacgtcttattaatggatttatgcgcggcattcgtgcatttattacataaagttgaaaaattggaaggcaaa

SEQ ID NO: 110 - DNA, 3153 bp, Artificial Sequence
  Synthetic: STF-48
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcagttagaaagcgatgctgatggaatgggagatgcactagttgcagttaagcagccatatatcggctcaatagctttaactcaacatgataaaaataccaacttcatttcagccaaggatttcggtgcaacagctgacggaactctgcatccactcagcgagaaattctccacactatcagcggcgcaggctgtttatccattcgtaacatcactaactcagtctcttgactatgcaggcatacaggccgcaattaatacagggcggaatgtattattgacatctggaacttacttcgtaaatgcaacgatagagatgaattcaaactgcacaataaatggcgaaacaaacagcaacataaataggccggaaactttcatagcagtaataggaaatatagcttgtttccattaccacgcagcgtttaatacaataaatattgaaaatgtctatattttttacgatggaggacgccctacatcacctactggcaatgatggtaaaattggcattctaattgatggaggaactacttcaccaggcgttatgcacattaaaaatgttgaggttgatggtgcatggtgggccatatatgatgactctggaaattacctaacaaagtatacccaggtatgggcgaggagagttgcgcatggtttctataaggcgaacggaacgacaatacagtgggatacatgttatgtgctggatgcagcacaggcatggtatgttgtaaattgcctgtctcctcagctaataaactgtgcaggagaccagatcacagttgacgggtcgcaatatacatttgattcctcagggttatatttttctggatgtaagtgtcttactattacagggtatgatggtgagtctaatataataaaaaatacaaatggaattactgcgtcgtatataaaacttaatgatactattgcccatatatcaggattggccgggcatggaaactcaatgcaaacaacggggagtgggacagcagcatttatctttgcaacaggcacaagcattgttaacataaaatcaagtaccgatagcttccttgatagcgaatcaataacctacactggctctggatacccaaacacattgctgacagactcaacagcaaaaataattgctgagggatgccggtttaaggctccgactggtgggactcctgtaatatcaacttacagcacagggaatggagtatttactgactgctcattaactgggacgcaaacttcaggctcatatgttgaatcacgaagctctgcaggtaatcagttgccagcagtgtacacagcgaaaggaactcaggctgttgcagctaacgtagcaactacgttgtttgaactgccaaatagccaagggatgtacctgataagcgtttgggcagaaagcagtggaacaaatttctcttcgcttcagcttgccatgtgggacggaacaacacttactttaactccgcttaagtcaggagggttgatatcatttacagtgacaggaaggattgtaaccatcacaagccagggaacaacaacatttaactggacatacaccaaggcaggg

SEQ ID NO: 111 - DNA, 4095 bp, Artificial Sequence
  Synthetic: STF-49
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggggctattggtgatggtgttcatgatgatacatcagctctatcagaattactttctgttgcaacaggtggtgaaaagatagatgggcgagggcttacttttaaagtatcaactcttccagatgtcagtcgatttaaaaatgctcgttttttatttgagagaataccgggtcagcctcttttttatgcttctgaagattttatccagggagagttatttaaaattacagatacaccgtggtacaacgcctggacgcaggataaaacgtttgtatatgacaatgtcatctatgcgccttttatggctggagaccgccatggtgtaaataacctccatgttgcatgggttcgctcaggagatgacgggaggacctggacaacgccggaatggcttacagatttacatgaaaactatcccacagttaactatcactgcatgagtatgggggttgtcagaaatcgcctttttgctgtaattgagacgcggaccgtgagcggaaataaactgcaggttgcagagttgtgggatcgcccaatgagtcgcagccttcgcgcttatggtggtataacgaaagcagcaaatcagcaagtcgcttatattcgcattactgatcacggattatttgctggtgattttgtcaacttctcaaactctggtgttacaggtgttaccgggaatatgacggtgactactgttattgataaaaatacttttacagttacgacgcaaaatacccaggatgtggatcagaataacgagggtagatactggagttttggtacatcatttcactcgtcaccatggagaaaaaccagtcttggaactattccttcttttgttgacggaagcactcctgttactgagattcacagttttgcgacgattagcgataacagttttgctgttggctaccataatggtgatattggtccacgcgagcttgggatactctatttctctgatgctttcggttctcctggtagctttgttcgcagacgcatacctgcagaatatgaggcgaatgcatctgagccatgtgtaaaatattatgatggcattctgtatctgacgaccagggggacattaagtactcaacccggtagttcattgcacagaagctctgatttaggtacatcatggaattctcttcgcttcccaaataatgttcatcactcaaaccttccttttgccaaagttggcgatgagctgattatttttggcagtgagcgcgcatttggtgagtgggaaggaggagaacctgataaccgttatgcaggaaactatccaagaacatttatgaccagagttaacgtcaatgagtggagtctggataatgtagagtgggttaatgttactgatcagatttatcagggcggaatagttaactctgcggttggtgttggttcagtttgtatcaaagacaactggctgtactacattttcggtggggaagactttctaaacccatggagcataggggataacaacagaaaatatccttatgttcacgatggtcacccggctgatttgtattgtttcagggtgaaaattaaacaggaagaatttgtttcaagggattttgtctacggagccactcctaacagaacgcttcctacttttatgtcgacgtcaggcgtgaggacggttcctgtacccgttgatttcacagatgatgttgccgtccagtcactgactgtccatgcaggtacatcaggacaagttcgcgcggaagtcaaacttgagggtaattacgccattattgcgaagaaagtaccgtctgatgatgttaccgctcagagattaatcgttagcggcggtgaaacaacgtcttcagcagatggtgcaatgataacgttgcatggttccggaagcagtactcctcgtcgcgcggtatataacgcactcgaacatctttttgagaacggagatgttaaaccttatcttgataatgtaaatgctcttggtggtccgggaaacaggttctcgacagtttatcttggctccaatcctgtggttaccagtgacggaacattaaagacagagccggtctctcctgacgaagcattgctggatgcctggggtgacgtcaggtatatcgcttataaatggctgaacgctgtcgctataaagggggaagaaggggcgaggatacatcatggtgtaatcgcgcagcaacttcgtgatgttcttatttctcacggactcatggaagaagaaagcacaacatgccgctatgcgtttctttgctatgacgattatcccgcagtatatgatgacgtcattactggccaaagggaaatgccgctgactgataatgacgggagcatcattgttgatgaggatgataatccagtgatggtaatggaagacatcattgagcgcgttgaaataacgccagcaggatctagatggggggtcagacctgatctcttattctatatcgaggcggcatggcagcgcagagaaatagaaagaataaaagctaggttagacttaatagaagggaagcac

SEQ ID NO: 112 - DNA, 3153 bp, Artificial Sequence
  Synthetic: STF-52
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgcagctagcaagctcagaagatggaatgggtgacgcactagttgcagttaagcagccatatatcggctcaatagctttaactcaacatgataaaaataccaacttcatttcagccaaggatttcggtgcaacagctgacggaactctgcatccactcagcgagaaattctccacactatcagcggcgcaggctgtttatccattcgtaacatcactaactcagtctcttgactatgcaggcatacaggccgcaattaatacagggcggaatgtattattgacatctggaacttacttcgtaaatgcaacgatagagatgaattcaaactgcacaataaatggcgaaacaaacagcaacataaataggccggaaactttcatagcagtaataggaaatatagcttgtttccattaccacgcagcgtttaatacaataaatattgaaaatgtctatattttttacgatggaggacgccctacatcacctactggcaatgatggtaaaattggcattctaattgatggaggaactacttcaccaggcgttatgcacattaaaaatgttgaggttgatggtgcatggtgggccatatatgatgactctggaaattacctaacaaagtatacccaggtatgggcgaggagagttgcgcatggtttctataaggcgaacggaacgacaatacagtgggatacatgttatgtgctggatgcagcacaggcatggtatgttgtaaattgcctgtctcctcagctaataaactgtgcaggagaccagatcacagttgacgggtcgcaatatacatttgattcctcagggttatatttttctggatgtaagtgtcttactattacagggtatgatggtgagtctaatataataaaaaatacaaatggaattactgcgtcgtatataaaacttaatgatactattgcccatatatcaggattggccgggcatggaaactcaatgcaaacaacggggagtgggacagcagcatttatctttgcaacaggcacaagcattgttaacataaaatcaagtaccgatagcttccttgatagcgaatcaataacctacactggctctggatacccaaacacattgctgacagactcaacagcaaaaataattgctgagggatgccggtttaaggctccgactggtgggactcctgtaatatcaacttacagcacagggaatggagtatttactgactgctcattaactgggacgcaaacttcaggctcatatgttgaatcacgaagctctgcaggtaatcagttgccagcagtgtacacagcgaaaggaactcaggctgttgcagctaacgtagcaactacgttgtttgaactgccaaatagccaagggatgtacctgataagcgtttgggcagaaagcagtggaacaaatttctcttcgcttcagcttgccatgtgggacggaacaacacttactttaactccgcttaagtcaggagggttgatatcatttacagtgacaggaaggattgtaaccatcacaagccagggaacaacaacatttaactggacatacaccaaggcaggg

SEQ ID NO: 113 - DNA, 2793 bp, Artificial Sequence
  Synthetic: 1AR
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcgctacccgcgtgtccaaagaaggtgacactatgactggtaagctgactctgtctgcgggtaacgatgcgctggtgctgactgcgggcgagggcgcgtcctcgcacattcgctctgacgtgggcgggacgaacaactggtatatcggtaaaggcagtggggataacggtttaggcttctactcatacatcactcagggcggggtgtatattaccaacaacggggaaatcgctttaagcccgcagggtcagggtacgtttaacttcaaccgtgatcgtctgcacatcaacggcacgcaatggacggcacatcaaggcggtggctgggaaaaccagtggaatcaggaagcgccgatttttattgatttcggcaacgtgggcaatgatagctactacccgattatcaaaggtaagtccggcattaccaacgaaggttatatttctggcgtggacttcggtatgcgtcggattactaacacgtgggcgcagggtattatccgcgtaggcaatcaggaaaacggtagcgatccgcaggccatctacgagttccatcataatggcgtactgtacgttcctaatatggtaaaaacgggtgcgcgtctgagcgcaggtgggggggatccggtatggcagggtgcatgtgttgttatcggtgacaatgacacgggcttagtgcatggtggcgatggtcgcatcaatatggttgcaaacggtatgcacattgcgtcttggagttccgcgtatcatttacatgagggtttatgggatactacgggcgcgttatggacggagcaagggcgtgcaattatcagcttcggtcatctggtacaacaaagcgatgcctattccacctttgtccgtgatgtatacgttcgttcggatattcgcgttaaaaaagatctggtgaaattcgaaaacgctagcgaaaaactgtccaaaatcaacggttatacttatatgcagaaacgcgggttagacgaagaaggtaatcagaaatgggagcctaacgccggattaatcgcgcaggaagtgcaggcgattctgccggaactggtagaaggcgatccggacggtgaagcattattacgtctgaactacaatggcgtgatcggcctgaatactgcggcgattaatgaacatacggcagagatcgcggagctgaaaagcgagattgaagaactgaaaaaaattgtcaaaagcctgttaaag

SEQ ID NO: 114 - DNA, 780 bp, Artificial Sequence
  Synthetic: 1AR-AP1
atggcagtaacaggaccgtgggtaggatcgtctgcagtagttaatacaggacaaaattggatggtcggcgcggcccaacgattaagaatgggtgctccgttctggatgagcaacatgattgggcgctctgttgaagtgattcatacgttaggcgcagatcataattttaatggtcaatggtttcgtgaccgttgctttgaggcgggcagtgcgccgatcgtgtttaacatcactggcgatttagtttcttactcccgtgacgttccgctgtttttcatgtatggtgacacgccgaacgagtatgtacaattaaacattcacggtgtcacgatgtacgggcgcgggggcaacggttgggcggcgggtgcaatcggtgcgagcgatggcggggtgtgcatccagaatgatattggaggccgactgcgtatcaacaatggtggggcaatcgcgggcggtggcggtggtgggggtggttattctcaggctaacaattgggcaggtaagtacgtttgcggtggcggtggcggtcgtccgttcggcttaggtggcaacaacggtgcgcgttggcctgggggcaacgctagcctgacctcgccgggcgcaggtgggaacactggcacgcgttattacgctggcgggggaggtgaggttggtcagccgggtcagtatgcaaaccccggcgcgggttactccaccccaccaacgtcgccgggcgcggcagttgcaggtagtgcgccaacttggcaaaacgtgggcgctatttatggcccgcgtgtttaa

SEQ ID NO: 115 - DNA, 243 bp, Artificial Sequence
  Synthetic: 1AR-AP2
atgagtgaacagaccatcgaacaaaaattaagcgcggaaatcgtgactctgaaaagtcgcattctggatactcaggaccaggcagcacgtctgatggaagagtctaaaatcttgcagggcactctggcagaaattgcccgtgcggtgggtatcacaggcgacacgatcaaagtagaagaaattgtggaggccgtaaagaatctcacagcggagagcaccgatgaagcaaaagacgaagaataa

SEQ ID NO: 116 - DNA, 2706 bp, Artificial Sequence
  Synthetic: 13-13.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 117 - DNA, 780 bp, Artificial Sequence
  Synthetic: 13-13.0-AP1
atggcagtagttggagttcctggctggattggaagttcagccgtaaatgaaacgggtcagcgctggatgagtcaagcagctggtcaattaagattgggtgttccttgctggatgagtcaatttgcaggtcgctcaagagaaattattcatacacttggagcagaccataacttcaatggtcaatggttccgagatagatgttttgaggcaggtagtacacctatagtgtttaatatcactggagatttagtatcatattctaaagatgttcctttattcttcatgtacggagatacaccgaatgaatatgttcaactgaatatacacggcgtaacgatgtatggacgtggcggtaatggcggtagcaatagtcctggttcagctggaggtcattgtattcaaaacgatattggtgggagactaagaattaataacggtggagctattgccggcggcggcggtggcggcggtggcggtagatatggcagactatcatttggtggtggcggtggtcgcccattcggtgctggcgggtcttcctctcatatgagttccggtgcaactgctggcaccatttccgctccgggtgcaggatctgtcggtgagggatctctttgggtatatacaggcggttcgggtggtaatgtcggtgctgctggaggaagatgtaatattcaaggtaacggtacagaatatgatggcggtgctgctggttatgctgttatagggtctgctccaacttggataaatgttggagcaatatatggtccaagagtataa

SEQ ID NO: 118 - DNA, 243 bp, Artificial Sequence
  Synthetic: 13-13.0-AP2
atgtctgaacaaactattgaacaaaaactgtctgctgaaatcgtaactctgaagtctcgtatccttgatacgcaggaccaagcggctcgtctgatggaagaatccaaaattctgcaaggaactttggctgaaattgctcgtgcagtaggtatcactggcgatactatcaaagttgaagaaatcgttgaagctgtcaagaatcttactgctgaatctgcagatgaagcaaaagatgaagaatga

SEQ ID NO: 119 - DNA, 2283 bp, Artificial Sequence
  Synthetic: 13-14.3
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtatttctgatgatattggatggatgcattatattcaacgaaataaagataatacagttgaagccgtattaaatggtcaacagacaattaacgaaaatattattgcgaaaaaggatatttgggttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattc

SEQ ID NO: 120 - DNA, 777 bp, Artificial Sequence
  Synthetic: 13-14.3-AP1
atggcagtagttggagttcctggctggattggaagttcagccgtaaatgaaacgggtcagcgctggatgagtcaagcagctggtcaattaagattgggtgttccttgctggatgagtcaatttgcaggtcgctcaagagaaattattcatacacttggagcagaccataacttcaatggtcaatggttccgagatagatgttttgaggcaggtagtacacctatagtgtttaatatcactggagatttagtatcatattctaaagatgttcctttattcttcatgtacggagatacaccgaatgaatatgttcaactgaatatacacggcgtaacgatgtatggacgtggcggtaatggcggtagcaatagtcctggttcagctggaggtcattgtattcaaaacgatattggtgggagactaagaattaataacggtggagctattgccggcggcggcggtggcggcggtggcggtagatatggcagactatcatttggtggtggcggtggtcgcccattcggtgctggcgggtcttcctctcatatgagttccggtgcaactgctggcaccatttccgctccgggtgcaggatctgtcggtgagggatctctttgggtatatacaggcggttcgggtggtaatgtcggtgctgctggaggaagatgtaatattcaaggtaacggtacagaatatgatggcggtgctgctggttatgctgttatagggtctgctccaacttggataaatgttggagcaatatatggtccaagagta

SEQ ID NO: 121 - protein, 1064 aa, Artificial Sequence
  Synthetic: K1F tail fiber
MSTITQFPSGNTQYRIEFDYLARTFVVVTLVNSSNPTLNRVLEVGRDYRFLNPTMIEMLVDQSGFDIVRIHRQTGTDLVVDFRNGSVLTASDLTTAELQAIHIAEEGRDQTVDLAKEYADAAGSSAGNAKDSEDEARRIAESIRAAGLIGYMTRRSFEKGYNVTTWSEVLLWEEDGDYYRWDGTLPKNVPAGSTPETSGGIGLGAWVSVGDAALRSQISNPEGAILYPELHRARWLDEKDARGWGAKGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 122 - DNA, 240 bp, Artificial Sequence
  Synthetic: 13-14.3-AP2
atgtctgaacaaactattgaacaaaaactgtctgctgaaatcgtaactctgaagtctcgtatccttgatacgcaggaccaagcggctcgtctgatggaagaatccaaaattctgcaaggaactttggctgaaattgctcgtgcagtaggtatcactggcgatactatcaaagttgaagaaatcgttgaagctgtcaagaatcttactgctgaatctgcagatgaagcaaaagatgaagaa

SEQ ID NO: 123 - protein, 1083 aa, Artificial Sequence
  Synthetic: WW13
MATLKQIQFKRSKTAGARPAASVLAEGELAINLKDRVLFTKDDQGNIIDLGFAKGGSIDGNVIHIGNYNQTGDYTLNGTFTQTGNFNLTGIARVTRDIIAAGQIMTEGGELITKSSGTAHVRFFDGNSRERGIIYAPANDGLTTQVLNIRVQDYAAGSESTYAFSGSGLFTSPEVSAWKSMSTPQILTDKVITNGKKTGDYDIYSLSNNTPLAESETAINHLRVMRNAVGAGIFHEVNVNDGITWYSGDGLDTYLWSFNWAGGLKAGHSISVGLPGGSKGYSELGTASIALGDNDTGFKWHQDGYFHTVNNGTRTFIYGPAETQSLRKMVMGYSPDGILMTTPPTENYALATVVTYHDNNAFGDGQTLLGYYQGGNYHHYFRGKGTTNINTHGGLLVTPGNIDVIGGSVNIDGRNNNSTLMFKGYTMGQSSVDNMYIAVWGNTFTNPSEGTRKNVMEISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 124 - protein, 1103 aa, Artificial Sequence
  Synthetic: PP-1
MATLKQIQFKRSKTAGQRPAASVLAEGELAINLKDRVLFTKDDQGNIIDLGFAKGGSIDGNVIHKGNYNQTGDYTLNGTFTQTGNFNLTGIARVTRDIIAAGQIMTEGGELITKSSGTAHVRFHDSADRERGIIFSPANDGLTTQVVNIRVQDYKASSESTFAFNGNGLFSSPEVFGWKSVSTPVIYTNKVITNKKVKDDYDIYSMADNVPLSEITTAINHLRVMRNAVGSGIFHEVKDNDGITWYSGDGLDAYLWSFTWSGGIKSSHSISIGLTPGPKDYSILGPSSIALGDNDTGFKWHQDGYYFSVNNGTKTFLFSPSETTSLRKFVAGYSTNGTDLTTPPTENYALATVVTYHDNNAFGDGQTLLGYYQGGNYHHYFRGKGTTNINTHGGLLVTPGNIDVIGGSVNIDGRNNASTAMFKGNTTGSSSVDNMTISVWGNTFTNPSEGNRKNVMEISDATSWMSYIQRLTTGEVEMNVNGSFESSGVTAGNRGVHTTGEISSGAVNALRIWNADYGVIFRRSEGSLHIIPTAYGEGKNGDIGPLRPFSIALDTGKVVIPDLESSYNTFAANGYIKFAGHGAGAGGYDIQYSQAAPIFQEIDDAAVSKYYPIVKQKFLNGKAVWSLGTEINSGTFVLHHLKEDGSQGHTSRFNADGTVNFPDNVQVGGGEATIARNGNIFSDIWKTFTSAGETTNIRDAIATRVSKEGDTMTGKLTLSAGNDALVLTAGEGASSHIRSDVGGTNNWYIGKGSGDNGLGFYSYITQGGVYITNNGEIALSPQGQGTFNFNRDRLHINGTQWTAHQGGGWENQWNQEAPIFIDFGNVGNDSYYPIIKGKSGITNEGYISGVDFGMRRITNTWAQGIIRVGNQENGSDPQAIYEFHHNGVLYVPNMVKTGARLSAGGGDPVWQGACVVIGDNDTGLVHGGDGRINMVANGMHIASWSSAYHLHEGLWDTTGALWTEQGRAIISFGHLVQQSDAYSTFVRDVYVRSDIRVKKDLVKFENASEKLSKINGYTYMQKRGLDEEGNQKWEPNAGLIAQEVQAILPELVEGDPDGEALLRLNYNGVIGLNTAAINEHTAEIAELKSEIEELKKIVKSLLK

SEQ ID NO: 125 - protein, 980 aa, Artificial Sequence
  Synthetic: WW55
MADLSRIQFKRTSTKGRRPDASTMNPGELAINLADQYLLTKNDSGAIINLSCPPVYDRDVTMAGKVKGNNYILSKTANYLEDQTARDLNYFGAFRTNGLDGLLELTLNVPHSSGVQHGRGFTFQYGHTGSRVETYGYNKEGQKAFSYKMYHEGDKPTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKK

SEQ ID NO: 126 - protein, 980 aa, Artificial Sequence
  Synthetic: WW34
MADLSRIQFKRTSTKGRRPDAGTMNPGELAINLADQYLLTKNDSGAIINLSCPPVYDSDVTMAGKVKGNNYILSKTANYFEDQTARDLNYFGAFRPNNADDWSNLILNIPHPSGKAHGRGFEFQYGSSSSQVKTYGFDKDGNKRFSFRMYHEGDKPTPGELNVYSKQEIDRMFVKNVKMSTPSGEATRGYFKIASAMIPQSGRMAFLRIYGGNGFNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSAIPGSYKGYVITGKMELHGSGNSMILHRQTAQAAYMSWWDRRDGKNQRSGYIGHADGTSDAIVWNNDIGQNSAVLETSGQISFRTGATKIVYTNGQYYSANSDAYRMIFGNYGAFWRNDGTKVYLLSTAENDKYGGWNAYRPFIYDLTSGNVQLGGDGNEDALTLECASRAARFSNDVYIKKGLLTFDAGRAGSRDYIRFNHWGDSNNARDNVLCIEDSQGRHFSTERAMGTGALKAYFLGDLEVGGKFTWGKNTATSSFNIRAWGNDSRKQVLECADESGWHWYTQRTGGPDTSAIDFAINGTVRPQAIHTGGNITINGADIEFKRTGNKHIWFRDPNGLELGLMYCDDAGAIRFRGQKQAQAWKFADKMIQLESGTVSGGGNGLIRGEVAGGSWASWRDRAAGLMVGCPQSTNSAHNVWKATHWGKYHIAAMAVHVPDGTITNALARLNVHDANFDFSASGDLSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 127 - protein, 1302 aa, Artificial Sequence
  Synthetic: WW14
MATLKAIQFKRSKTPGAKPTVDQLVEGELAINLRDRTIFTKSDQNQIIDLGFAKGGQVDGDVTINGTLNLNGPEIVASGGYIEFNYRTTGSGSWAGQHAAKAPIFVDLSAALSTSEYNPLFKQRYKDGTFSAGTLVTEGSFKFHYINEAGDSKYWTFNRNGNFQVDTGSLFVSGGNISASGNINSASGFVSAPQINTKNIILDTKAFGQYDSQSLVNYVYPGTGETNGVNYLRKVRAKSGGTMWHELCTAQLGQADEMSWWTGNTPQSKQYGVRNDGRLIGRNSLALGTMTTDFPSSDYGNTGAMGDKYLVLGDTATGLKYIKQGNFDLVGGGYSVASITTDGFRGTSKTLFGRSNDQGLTWLLPGQNSAMVSIRTEIDGNNSGDGQTHLGYNSNGKLYHYFRGTGRVAISMAEGMIIEPGILNIKTGVNELNLRADGTVSTTQRLMVNNGLVLNANNNTSALALTAPTGVDGTKTINWDAGTRNGQNKNTVTMKAWGNSFNAGGGNRETVFEVSDSQGYYFYGQRTNPASGETVGPINFKFNGSVETGHFSSLGNISASGTGSFGGNVTMTNGLFVQGGASINGQVKMGGTADALRIWNAEYGMIFRRSETGSSASFHLIPTLQNAGENGGISDLRPLSINLASGTVIMGNKSTGGPLFTVDNVSKFVQTDCRLRVNMDSDGIVLNASSQAASNFIQGRKADVTKWYLGIGDGGNVVRMHNYTYSHGIALNSDTVDITKPLKIGSDIRIGTDGNIIGSATLDNFKNLNTTLDHKVNMGGWSGGATTGWYKFATVEIPQATGTASFKIFGGSGFNFKSYGQASIAEIILRTGNNNPKGLNATLWNRTSEAISQIASVNTSEDIYDIYVYLGGYSNSLVVEYTCSSNSKVTVVGMDGGVQPLVETLPEGHVVGKSVRMLNNLDGMFAAGESDIVTRGEYVTNNQKGMRIKSKGNDLDSNAALLRNDGGSFYILATDKNTTEKPDAANGDWNGLRPFSINMADGRVGMNHGLNITGGGLNVTGGNTNLGNITSRVVSSARAGSGWGDNSDAMKSKITFMADHGDLSNSGSYYPIVGAYSNYGSAGYRQTFEFGWVGSGSTANWREGIIRIRGDNANGQQARWRFTMDGILGCPGKVEMPETSAFGINTTNGFGGNSIVIGDSDTGFRQVGDGLLEVWTNASRRMRFQGGDTYSDMNINAPNVYIRSDIRLKSNFKPIENALDKVEQLDGLIYDKADYIGGEVVHTEAGVIAQSLEKVLPEAVREVDDIKGNKVLTVSTQAQVALLIEAVKTLSAKVKELEAKLN

SEQ ID NO: 128 - protein, 976 aa, Artificial Sequence
  Synthetic: WW170
MADLSRIQFKRTSTKGRRPDASTMNPGELAINLADQYLLTKNDSGAIINLSCPPVYDRDVTMAGKVKGNNYILSKTANYLEDQTARDLNYFGAFRTNGQDGLLDLTLNVPHSAGVNHGRGFTFRYATGGSRVETYGYNAQGQKAFSYKMYHEGDKPTPSELNVYSKQEVDRMFVKTVKLATVPVDIVDGYFKLATAMIPQNGRSVFFRIHGGNGYNVTAYDQVDIVEIVIRSGNNRPKGVNVIAYRRNTNKAFDVLAVNTSGDNYDIYVKYQRYTDNVIVEFGKSVDVDLVVHDVPDFVVDRPVGDNVIGGRAVTLFNTENKRGVLSFDDNTQNSYDIVHLSNDRGTGRKYIRKFRSNYNEMIWHETVQGSTYRLATGSTDAQEILSVESSSSIAGTHKGNILSGRMMLGGGSNVITLRRPAGQSNHIAFQDNRTGSITRQGWIGYGNADTNVFEWYSDVGGTSIRHHIDGQIELATGNTKRVYTNAQFISMNSDAYRMIFGNYGAFWRNDGTKVYLLSTAEDDKFGGWNGNRPFIYDLTNGKVTLGGDGNEGALVLERDSRAARFAGDVYVEKGFLHFSSGRQGASGFMKINHLGDIASGRHNILQIEDPTGIHFSTERNDETGNITARFKGFVRVEAGEIAFDANRGSQSQFTLHTWGNEQRKQVFECKDATGYHWYTERTQGGTGNVLFSMAGSLNVTSNITTTGADITFKRAGNKHIWFRDPDGLELGLMYCDDAGAIRFRGQKQAQAWKFADKMIQLESGTVSGGGNGLIRGEVAGGSWSSWRDRAAGLMVGCPQSTNSAHNVWKATHWGKYHIAAMGIHVPDGTIGNALARLHVHDTNFDFSASGDMTAGRNGSFNDVYIRSDARLKINKEEYKENATDKINRLTVYTYDKVKSLTDRTVIAHEVGIIAQDLEKELPEAVTTSKVGDPDKPEEILTISNSAVNALLIKAFQEMSEELKAVKAELAELKKN

SEQ ID NO: 129 - protein, 966 aa, Artificial Sequence
  Synthetic: WW202
MADLNRIQFKRTSTAGRKPDAGTMNPGELAINLADQYLLTKNDDGQIVNLSCPPVYDKGFDVRGRVVVDDLVWSNTANYFDDPTARNLDKFGAFRTNDMDGHLAFALHIPHPSGINHARGFDFTYGSNVVPTVKTYGYNADGVLAYSYRMYHEGDKPSPSELNVYSKQEVDRMFQKTINFGVETGWFKIATAFIPQNDGRSLKIRLVGGNGWNVGQTGQCNIIELVIRTSNGSPKGINFVAYHHVSGYENQFCAINTGDDTYDIYAYYYEFTNMVMAEYQASSDVNLTVFDRPEYVGEKPVAEHIFDAYTIHSFNSFSNRGTLNFAGNHQGQYDIEHMNEQPTNAKKMLRRFRSSASATIWHETVDDQNYRLATGGTDSVQQLLLSSGTGLHIRRLTIDGGLGSGSNAGIDIRRGPNESSHFNFMDYRTGQDVRNGWFGFGDLTTKDFIWWNDNGQNSINLIENGELHITGGRGQKIVMNSEVALSENARLAVKGGNYGLILRNDGTGFHILTTDLKDSFGSWNNRRPFSYNFADGGLYLGGTETARCLHLGIDGSTRLEDNLFFKAGSRQSMDYMELVHWGASNTGRNNVLSLRDSKGFLAEFERVGGTDGVKTRFFGETFTDGTLYLNQMNNSSERFSINNWGNSEVGRAAVMEVGDSKGYHFYAERRTDDTVLFDVSGALTVHGPNGITVKNSTGARHIWFRDDSDTEKAVIWATDDGMLHIRNNHEGSFAHHFQGAMIKLEGRVPYGAAKGLIRGEVDGGAYVAWRDRPAGLLVDCQKSIDSAHAVWKAVDWGRQYIAAMDVHCPGDGNNTAAAVLHVQAADYQFHASGEFHASGNGNFNDVYIRSDRRLKDNIEDYTGNALSLIGKLKVKTYDKVKSLKDREIIGHEIGIIAQDLQEILPEAVKSSKVGNLDNPDDVLTISNSAVNALLIKAIQEMSEEIKELKTPFFTKIARKISKYFKF

SEQ ID NO: 130 - protein, 901 aa, Artificial Sequence; identical to SEQ ID NO: 56
  Synthetic: WW13 13.0  (FIG. 8)

SEQ ID NO: 131 - protein, 979 aa, Artificial Sequence
  Synthetic: WW13 10.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 132 - protein, 1432 aa, Artificial Sequence
  Synthetic: WW13-G8 (FIG.10)
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGNIIDLGFAKGGSIDGNVIHIGNYNQTGDYTLNGTFTQTGNFNLTGIARVTRDIIAAGQIMTEGGELITKSSGTAHVRFFDGNSRERGIIYAPANDGLTTQVLNIRVQDYAAGSESTYAFSGSGLFTSPEVSAWKSMSTPQILTDKVITNGKKTGDYDIYSLSNNTPLAESETAINHLRVMRNAVGAGIFHEVNVNDGITWYSGDGLDTYLWSFNWAGGLKAGHSISVGLPGGSKGYSELGTASIALGDNDTGFKWHQDGYFHTVNNGTRTFIYGPAETQSLRKMVMGYSPDGILMTTPPTENYALATVVTYHDNNAFGDGQTLLGYYQGGNYHHYFRGKGTTNINTHGGLLVTPGNIDVIGGSVNIDGRNNNSTLMFKGYTMGQSSVDNMYIAVWGNTFTNPSEGTRKNVMEISDDIGWMHYIQRNKDNTVEAVLNGQQTINENIIAKKDIWVDRAVHTLGEITTNAVNGLRIWNNDYGVIFRRSEGSLHIIPTAFGEGETGDIGPLRPLSIALDTGKVTIPDLQSSYNTFAANGYIKFVGHGAGAGGYDIQYAQAAPIFQEIDDDAVSKYYPIVKQKFLNGKSVWSLGTEIESGTFVIHHLKEDGSQGHASRFNQDGTVNFPDNVLVGGDINMKGMMTFDAGRLGSRDYFKFNHWGDSNNGRDNIIQLEDSQGAHFSTERTLATGAIKTRFFGETFTDGTLYLNQMNNSSERFSINNWGNSEVGRPAVLEVGDSKGYHFYTERGTDNSLNFDVAGNFTVHGPSGITIKTSTGARHIWFRDDSDAEKAVIWATDEGILHIRNNYGGSFSHHFQGAMILAGERVPYNSEYALIRGNISGGAWVDWRGRPAGLLVDCQDSRNQAYNIWKATHWGDQHLAAMGVHAGGGNPQVVLHVGGNDYAFASNGDFTAGAAVYCNDVYIRSDRRLKINVKDYEENAVDKVNKLKVKTYDKVKSLSDREVIGHEIGIIAQDLQEVLPEAVSTSSVGSQDNPEEILTISNSAVNALLIKAIQEMSEEIKELKTPLFTKIARKISKYFKF

SEQ ID NO: 133 - protein, 259 aa, Artificial Sequence; identical to SEQ ID NO: 57
  Synthetic: WW13 gp38

SEQ ID NO: 134 - protein, 80 aa, Artificial Sequence; identical to SEQ ID NO: 58
  Synthetic: WW13 gp57A

SEQ ID NO: 135 - protein, 931 aa, Artificial Sequence; identical to SEQ ID NO: 53
  Synthetic: PP-1 (FIG. 8)

SEQ ID NO: 136 - protein, 259 aa, Artificial Sequence; identical to SEQ ID NO: 54
  Synthetic: PP-1 gp38

SEQ ID NO: 137 - protein, 80 aa, Artificial Sequence; identical to SEQ ID NO: 55
  Synthetic: PP-1 gp57A

SEQ ID NO: 138 - protein, 1217 aa, Artificial Sequence
  Synthetic: >WW55 3.0 (FIG. 9)
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKK

SEQ ID NO: 139 - protein, 1330 aa, Artificial Sequence
  Synthetic: >WW55-G8 (FIG. 10)
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGAIINLSCPPVYDRDVTMAGKVKGNNYILSKTANYLEDQTARDLNYFGAFRTNGLDGLLELTLNVPHSSGVQHGRGFTFQYGHTGSRVETYGYNKEGQKAFSYKMYHEGDKPTPGELNVYSKQEIDRMFVKNVKMVVPSGGATRGYFKIASAMIPQSGRMAFLRIYGGNGYNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSALPGSYKGYVITGKMELHGSGSAMNLHRQTGQAAYMAWWDRRDGKNQRSGYIGHADGTTDGFVWRNDVGANSFDLESSGQVNLTTGKTKIVYTNGQYYSANSDAFRMIYGNYGAFWRNDGGKVYLLSTAENDRFGGWNGNRPFIYDLSTGKVTLGGDGNEGALVLERDSRAARFSNSVFLEKGLLTFSAGGNQSMDSFTINHWGNSNAGRYNVLQFEDTKGTHFTTERNADGGLLAHFRGDLTTEGKLTWGKGTATSSFNIRAWGNSDSRKQVFECVDESGWHWYTQRPGGPGTSAIEFAINGTVKPQAIHTGGNILLNGADIEFRRTGNKHLWFRDPNGLELGLIYCDDNGVIRFRGQKQGQDWVFANKMIQLGTASTVGGSGNGLIRGQVQGGAWAQWRDRAAGILVDCQQSTDSAHNIWKATHWGKYHIAAMGVHVPSGTIGNAMARLNVNDANFDFSASGDMSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 140 - protein, 261 aa, Artificial Sequence
  Synthetic: >WW55 gp38
MAISSGWVGSSAVSETGQRWMSAAMQAVRLGRPAYMSAMVGRSKEIHYSIGASNSYNKDTLINWMKAQGSTPVVITITGNIVSQSTGVPCLDFPSSLTNEYVTLIINSGVHVLGRGGNGGSNSAGGAGGNAINNGIGTRLRINNNGIIGGGGGGGAGARYNPFPQMDMKFGGGGGRPFGAAGAAGGGAAAASAGTISAPGKGTVSGVHYGGDGGDLGAAGKSSYIKGGTGGTVHSGGAAGKAVTGNAPRWDKVGTIYGARV

SEQ ID NO: 141 - protein, 86 aa, Artificial Sequence
  Synthetic: WW55 gp57A
MSNQHEQMINVLKVRLFDTQEKAAFLEGQLKDRERVLMELVRILGIQPDENGTVSLDAIVEEVKALLPKDEAAEDAEEEVELITEA

SEQ ID NO: 142 - protein, 1217 aa, Artificial Sequence
  Synthetic: WW34 3.0
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRTPGELNVYSKQEIDRMFVKNVKMSTPSGEATRGYFKIASAMIPQSGRMAFLRIYGGNGFNVNSYDQVDFLEIVIRSGNNNPKGVSIAAYRRNSLNVHEVFAINTSGDNYDIYVNYGRFTDNVIVEFGKTVDVALTVHDVPEFSATKPETGTKFDARVITMFNTENKAGTLMFDNNNQLTYDIVSLSNGPDDVRNYLRKFRSKAGEMIWHETVQGAVYRLATGTTDSTEVLRVDSNSAIPGSYKGYVITGKMELHGSGNSMILHRQTAQAAYMSWWDRRDGKNQRSGYIGHADGTSDAIVWNNDIGQNSAVLETSGQISFRTGATKIVYTNGQYYSANSDAYRMIFGNYGAFWRNDGTKVYLLSTAENDKYGGWNAYRPFIYDLTSGNVQLGGDGNEDALTLECASRAARFSNDVYIKKGLLTFDAGRAGSRDYIRFNHWGDSNNARDNVLCIEDSQGRHFSTERAMGTGALKAYFLGDLEVGGKFTWGKNTATSSFNIRAWGNDSRKQVLECADESGWHWYTQRTGGPDTSAIDFAINGTVRPQAIHTGGNITINGADIEFKRTGNKHIWFRDPNGLELGLMYCDDAGAIRFRGQKQAQAWKFADKMIQLESGTVSGGGNGLIRGEVAGGSWASWRDRAAGLMVGCPQSTNSAHNVWKATHWGKYHIAAMAVHVPDGTITNALARLNVHDANFDFSASGDLSAGRNGSFNDVYIRSDARLKINKEEYKENATDKVNRLTVYTYDKVKSLTDRTVIAHEVGIIAQDLEKELPEAVTTSKIGDPDKPEEILTISNSAVNALLIKAFQEMSEELKAVKAELAELKKN

SEQ ID NO: 143 - protein, 259 aa, Artificial Sequence
  Synthetic: WW34 gp38
MAISSGWVGSSAVSETGQRWMSAAMQAVRLGRPAYMSAMVGRSKEIHYSIGASNSYNKDTLINWMKAQGSTPVVITITGNIVSQSTGVPCLDFPSSLTNEYVTLIINPGVHVWGRGGNGGNNSAGGAGGNAINNGIGTRLRITNNGAICGGGGGGGGGYYSPFSQMRLTFGGGGGRPFGAAGGSANMEQGATAGTISAPGKGSVNGVYNGGNGGDAGGAGGKCNIRGQGSEYNGGAAGKAVTGNAPRWDKVGTIYGARV

SEQ ID NO: 144 - protein, 86 aa, Artificial Sequence; identical to SEQ ID NO: 141
  Synthetic: WW34 gp57A

SEQ ID NO: 145 - protein, 1651 aa, Artificial Sequence
  Synthetic: WW14-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRNQIIDLGFAKGGQVDGDVTINGTLNLNGPEIVASGGYIEFNYRTTGSGSWAGQHAAKAPIFVDLSAALSTSEYNPLFKQRYKDGTFSAGTLVTEGSFKFHYINEAGDSKYWTFNRNGNFQVDTGSLFVSGGNISASGNINSASGFVSAPQINTKNIILDTKAFGQYDSQSLVNYVYPGTGETNGVNYLRKVRAKSGGTMWHELCTAQLGQADEMSWWTGNTPQSKQYGVRNDGRLIGRNSLALGTMTTDFPSSDYGNTGAMGDKYLVLGDTATGLKYIKQGNFDLVGGGYSVASITTDGFRGTSKTLFGRSNDQGLTWLLPGQNSAMVSIRTEIDGNNSGDGQTHLGYNSNGKLYHYFRGTGRVAISMAEGMIIEPGILNIKTGVNELNLRADGTVSTTQRLMVNNGLVLNANNNTSALALTAPTGVDGTKTINWDAGTRNGQNKNTVTMKAWGNSFNAGGGNRETVFEVSDSQGYYFYGQRTNPASGETVGPINFKFNGSVETGHFSSLGNISASGTGSFGGNVTMTNGLFVQGGASINGQVKMGGTADALRIWNAEYGMIFRRSETGSSASFHLIPTLQNAGENGGISDLRPLSINLASGTVIMGNKSTGGPLFTVDNVSKFVQTDCRLRVNMDSDGIVLNASSQAASNFIQGRKADVTKWYLGIGDGGNVVRMHNYTYSHGIALNSDTVDITKPLKIGSDIRIGTDGNIIGSATLDNFKNLNTTLDHKVNMGGWSGGATTGWYKFATVEIPQATGTASFKIFGGSGFNFKSYGQASIAEIILRTGNNNPKGLNATLWNRTSEAISQIASVNTSEDIYDIYVYLGGYSNSLVVEYTCSSNSKVTVVGMDGGVQPLVETLPEGHVVGKSVRMLNNLDGMFAAGESDIVTRGEYVTNNQKGMRIKSKGNDLDSNAALLRNDGGSFYILATDKNTTEKPDAANGDWNGLRPFSINMADGRVGMNHGLNITGGGLNVTGGNTNLGNITSRVVSSARAGSGWGDNSDAMKSKITFMADHGDLSNSGSYYPIVGAYSNYGSAGYRQTFEFGWVGSGSTANWREGIIRIRGDNANGQQARWRFTMDGILGCPGKVEMPETSAFGINTTNGFGGNSIVIGDSDTGFRQVGDGLLEVWTNASRRMRFQGGDTYSDMNINAPNVYIRSDIRLKSNFKPIENALDKVEQLDGLIYDKADYIGGEVVHTEAGVIAQSLEKVLPEAVREVDDIKGNKVLTVSTQAQVALLIEAVKTLSAKVKELEAKLN

SEQ ID NO: 146 - protein, 262 aa, Artificial Sequence
  Synthetic: WW14 gp38
MAIVGVPGWIGQSAVDETGQRWMDAAMRDVRVAVPGWMGSMAGQSKEIYLSIGANNSYDRNSLINWMRAQGGAPVVITITGNLVSNSTGNACLEFPSNLPNAYIQLIINSGVTVYGRGGNGSTNGSAGGNGGTAIHNAAGTKLRIRNNGAIAGGGGGGGAVSLQNSYPTNGTCGGGGGRPFGVGGKIGSDAILSGSNASLTAAGTGGATVQYGGGNGGNVGAGGGRGWGKNVYTSAGGSAGAAVTGNAPNWQNVGTIYGSRV

SEQ ID NO: 147 - protein, 76 aa, Artificial Sequence
  Synthetic: WW14 gp57A
MSEQTIEQKLQAEIVALKSRILDTQDVAAQAQQESRILQDALSKIAARLGITGDQIQIEDLIAAVPDLTAESADEE

SEQ ID NO: 148 - protein, 1325 aa, Artificial Sequence
  Synthetic: WW170-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGAIINLSCPPVYDRDVTMAGKVKGNNYILSKTANYLEDQTARDLNYFGAFRTNGQDGLLDLTLNVPHSAGVNHGRGFTFRYATGGSRVETYGYNAQGQKAFSYKMYHEGDKPTPSELNVYSKQEVDRMFVKTVKLATVPVDIVDGYFKLATAMIPQNGRSVFFRIHGGNGYNVTAYDQVDIVEIVIRSGNNRPKGVNVIAYRRNTNKAFDVLAVNTSGDNYDIYVKYQRYTDNVIVEFGKSVDVDLVVHDVPDFVVDRPVGDNVIGGRAVTLFNTENKRGVLSFDDNTQNSYDIVHLSNDRGTGRKYIRKFRSNYNEMIWHETVQGSTYRLATGSTDAQEILSVESSSSIAGTHKGNILSGRMMLGGGSNVITLRRPAGQSNHIAFQDNRTGSITRQGWIGYGNADTNVFEWYSDVGGTSIRHHIDGQIELATGNTKRVYTNAQFISMNSDAYRMIFGNYGAFWRNDGTKVYLLSTAEDDKFGGWNGNRPFIYDLTNGKVTLGGDGNEGALVLERDSRAARFAGDVYVEKGFLHFSSGRQGASGFMKINHLGDIASGRHNILQIEDPTGIHFSTERNDETGNITARFKGFVRVEAGEIAFDANRGSQSQFTLHTWGNEQRKQVFECKDATGYHWYTERTQGGTGNVLFSMAGSLNVTSNITTTGADITFKRAGNKHIWFRDPDGLELGLMYCDDAGAIRFRGQKQAQAWKFADKMIQLESGTVSGGGNGLIRGEVAGGSWSSWRDRAAGLMVGCPQSTNSAHNVWKATHWGKYHIAAMGIHVPDGTIGNALARLHVHDTNFDFSASGDMTAGRNGSFNDVYIRSDARLKINKEEYKENATDKINRLTVYTYDKVKSLTDRTVIAHEVGIIAQDLEKELPEAVTTSKVGDPDKPEEILTISNSAVNALLIKAFQEMSEELKAVKAELAELKKN

SEQ ID NO: 149 - protein, 259 aa, Artificial Sequence; identical to SEQ ID NO: 143
  Synthetic: WW170 gp38

SEQ ID NO: 150 - protein, 86 aa, Artificial Sequence
  Synthetic: WW170 gp57A
MSNQHEQMINVLKVRLFDTQEKAAFLEGQLKDRERVLMELVRILGIQPDENGTVSLDAIVEEVKALLPKDEAAEDAKEEVELITEA

SEQ ID NO: 151 - protein, 1315 aa, Artificial Sequence
  Synthetic: WW202-G8
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRGQIVNLSCPPVYDKGFDVRGRVVVDDLVWSNTANYFDDPTARNLDKFGAFRTNDMDGHLAFALHIPHPSGINHARGFDFTYGSNVVPTVKTYGYNADGVLAYSYRMYHEGDKPSPSELNVYSKQEVDRMFQKTINFGVETGWFKIATAFIPQNDGRSLKIRLVGGNGWNVGQTGQCNIIELVIRTSNGSPKGINFVAYHHVSGYENQFCAINTGDDTYDIYAYYYEFTNMVMAEYQASSDVNLTVFDRPEYVGEKPVAEHIFDAYTIHSFNSFSNRGTLNFAGNHQGQYDIEHMNEQPTNAKKMLRRFRSSASATIWHETVDDQNYRLATGGTDSVQQLLLSSGTGLHIRRLTIDGGLGSGSNAGIDIRRGPNESSHFNFMDYRTGQDVRNGWFGFGDLTTKDFIWWNDNGQNSINLIENGELHITGGRGQKIVMNSEVALSENARLAVKGGNYGLILRNDGTGFHILTTDLKDSFGSWNNRRPFSYNFADGGLYLGGTETARCLHLGIDGSTRLEDNLFFKAGSRQSMDYMELVHWGASNTGRNNVLSLRDSKGFLAEFERVGGTDGVKTRFFGETFTDGTLYLNQMNNSSERFSINNWGNSEVGRAAVMEVGDSKGYHFYAERRTDDTVLFDVSGALTVHGPNGITVKNSTGARHIWFRDDSDTEKAVIWATDDGMLHIRNNHEGSFAHHFQGAMIKLEGRVPYGAAKGLIRGEVDGGAYVAWRDRPAGLLVDCQKSIDSAHAVWKAVDWGRQYIAAMDVHCPGDGNNTAAAVLHVQAADYQFHASGEFHASGNGNFNDVYIRSDRRLKDNIEDYTGNALSLIGKLKVKTYDKVKSLKDREIIGHEIGIIAQDLQEILPEAVKSSKVGNLDNPDDVLTISNSAVNALLIKAIQEMSEEIKELKTPFFTKIARKISKYFKF

SEQ ID NO: 152 - protein, 260 aa, Artificial Sequence
  Synthetic: WW202 gp38
MAVVGVPGWIGSSAANETGQRWMSQAAGQLRLGVPCWMSQFSGRSREIIHTLGADHNFNGQWFRDRCFEAGSTPIVFNITGDLVSYSKDVPLFFMYGDTPNEYVQLNIHGVTMYGRGGNGGSNSPGSAGGHCIQNDIGGRLRINNGGAIAGGGGGGGGGYYSPFSQMRLTFGGGGGRPFGAPGGSIDMQSGATAGTLYAPGSGSVNGIYNGGSGGEVGAAGGRCNIRGQGYEYNGGDAGYAVIGSSPTWQNRGAIYGPAV

SEQ ID NO: 153 - protein, 86 aa, Artificial Sequence
  Synthetic: WW202 gp57A
MSNQHEQMINVLKVRLFDTQEKAAFLEGQLKDRERVLMELVRVLGIQPDENGTVSLDAIVEEVKALLPKDEAAEDAKEEVELITEA

SEQ ID NO: 154 - DNA, 2706 bp, Artificial Sequence; identical to SEQ ID NO: 116
  Synthetic: WW13 13.0

SEQ ID NO: 155 - DNA, 2940 bp, Artificial Sequence
  Synthetic: WW13 10.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 156 - DNA, 4299 bp, Artificial Sequence
  Synthetic: WW13-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggaaatattattgatctgggttttgctaaaggcggtagtattgacggaaatgttattcatataggaaattataatcaaactggtgattatactttaaatggcaccttcactcagacaggtaattttaatttaactggtattgctcgagtaactcgcgatattattgccgccgggcaaattatgactgagggcggagaacttattacaaaaagttcaggtacagcacatgttcgttttttcgatggcaatagccgcgaacgtggaatcatttatgccccggccaatgatggtttaactacgcaagttcttaatatcagggttcaagactacgccgctggtagcgaaagcacttatgcattttcaggcagtggcctatttacttcacctgaagtatcggcatggaaatctatgtcaactcctcagattttgaccgataaagttattacaaatgggaagaagacaggcgattatgatatctattcattatcaaataacactccattggcagaaagcgaaacggctattaaccacctccgtgttatgcgaaatgctgtaggagcaggtattttccacgaagttaatgttaatgacggaataacctggtattccggagatggcttagacacttatctttggtcgtttaactgggccggtggattgaaagctggtcattctatttctgtaggtcttccgggtggctctaaaggatattctgaattaggaacggcctcaattgctcttggtgataatgacaccggatttaaatggcatcaggacggatattttcatacagtaaacaatggaacaagaactttcatctacggccctgcggaaacacaaagccttagaaaaatggttatgggttattctccggacgggattcttatgacaacgccaccgacagaaaactatgctcttgctactgtagtgacataccacgataataacgcgtttggagatggtcaaactcttttaggatattatcaaggcggtaactatcatcactatttccgcggtaagggtactacaaacattaatactcatggcggtttgttagttactccaggcaatattgacgttattggtggttctgttaatatcgatggtagaaataataattcaactttaatgtttaaaggctataccatgggtcaaagctccgttgataacatgtatatagctgtttggggaaatacatttactaatcctagtgaaggcacccgtaaaaatgtcatggaaatttctgatgatattggatggatgcattatattcaacgaaataaagataatacagttgaagccgtattaaatggtcaacagacaattaacgaaaatattattgcgaaaaaggatatttgggttgaccgagcagttcacacccttggcgaaatcactacaaatgctgttaatggtcttcgtatttggaataatgattatggagtcatttttagacgttcagaaggaagtcttcatattattcctaccgcatttggtgaaggagaaaccggtgatattggacctttacgtcctctcagtatagctttagataccggtaaagttactattccggatttacaatcaagttacaatacgttcgctgctaacggttatattaaatttgttggtcatggagcgggggccggcggttatgacattcaatatgctcaagcggctcctattttccaggaaatcgatgatgatgctgtaagcaaatattatcctattgttaaacagaagtttttaaacggtaaatccgtttggtctttaggtaccgaaattgaatcaggtacattcgttattcatcatctgaaagaagatggttcacaaggccatgcgtctcgttttaatcaagacggtactgttaacttcccggataacgttctggtcggcggtgatattaacatgaaaggcatgatgacttttgacgccggacgtttaggatcacgagattattttaaatttaaccattggggtgatagtaataatggtcgtgataacatcatccagttagaagatagtcaaggcgcccatttttccactgaacgtactttagcgacaggtgcaattaaaactcgtttctttggcgaaacatttactgatggtacattatacctaaatcagatgaataatagttctgaacgattctctattaataattggggaaattcagaagttggtcgcccggcagtgttggaagtcggtgattccaaaggttatcacttctatacggaacgcgggacagataacagtttgaattttgatgttgctggcaattttactgtgcatggaccttccgggattactatcaaaacctctactggtgctcgccatatctggtttagagatgatagcgatgcagaaaaggctgttatctgggctacagatgagggtattttacatatacgaaataattatgggggttcatttagtcatcacttccagggtgcaatgattctagcgggagagcgtgttccatataatagtgaatacgctcttatccgtggtaatatttccggtggtgcatgggtagactggcgaggtcgtccggctggattgttggtagactgtcaggactcacgaaatcaagcatataacatttggaaagctactcattggggcgaccagcaccttgcggcgatgggtgttcatgctggcggtggtaatcctcaggttgtattgcatgtgggtgggaatgattatgcatttgcatctaacggtgattttactgctggtgctgctgtatattgtaacgacgtttatattcgttctgaccgtcgtctgaaaattaatgttaaagactacgaagagaatgcggtggataaggtaaataaactcaaagttaaaacctatgataaagttaaatctctttctgaccgcgaagttatcggccatgagattggtattatcgcacaggatttgcaagaagtattaccggaagctgttagcacttctagtgtcggatctcaggataacccagaagaaattttaacaatttctaactctgctgtgaacgcgcttttaattaaggctattcaggaaatgagtgaagaaattaaagaattgaaaacgcctctctttactaaaattgctcgcaaaattagtaaatattttaaattctaa

SEQ ID NO: 157 - DNA, 780 bp, Artificial Sequence; identical to SEQ ID NO: 117
  Synthetic: WW13 GP38

SEQ ID NO: 158 - DNA, 243 bp, Artificial Sequence; identical to SEQ ID NO: 118
  Synthetic: WW13 GP57A

SEQ ID NO: 159 - DNA, 2796 bp, Artificial Sequence
  Synthetic: PP-1
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgatcgctacccgcgtgtccaaagaaggtgacactatgactggtaagctgactctgtctgcgggtaacgatgcgctggtgctgactgcgggcgagggcgcgtcctcgcacattcgctctgacgtgggcgggacgaacaactggtatatcggtaaaggcagtggggataacggtttaggcttctactcatacatcactcagggcggggtgtatattaccaacaacggggaaatcgctttaagcccgcagggtcagggtacgtttaacttcaaccgtgatcgtctgcacatcaacggcacgcaatggacggcacatcaaggcggtggctgggaaaaccagtggaatcaggaagcgccgatttttattgatttcggcaacgtgggcaatgatagctactacccgattatcaaaggtaagtccggcattaccaacgaaggttatatttctggcgtggacttcggtatgcgtcggattactaacacgtgggcgcagggtattatccgcgtaggcaatcaggaaaacggtagcgatccgcaggccatctacgagttccatcataatggcgtactgtacgttcctaatatggtaaaaacgggtgcgcgtctgagcgcaggtgggggggatccggtatggcagggtgcatgtgttgttatcggtgacaatgacacgggcttagtgcatggtggcgatggtcgcatcaatatggttgcaaacggtatgcacattgcgtcttggagttccgcgtatcatttacatgagggtttatgggatactacgggcgcgttatggacggagcaagggcgtgcaattatcagcttcggtcatctggtacaacaaagcgatgcctattccacctttgtccgtgatgtatacgttcgttcggatattcgcgttaaaaaagatctggtgaaattcgaaaacgctagcgaaaaactgtccaaaatcaacggttatacttatatgcagaaacgcgggttagacgaagaaggtaatcagaaatgggagcctaacgccggattaatcgcgcaggaagtgcaggcgattctgccggaactggtagaaggcgatccggacggtgaagcattattacgtctgaactacaatggcgtgatcggcctgaatactgcggcgattaatgaacatacggcagagatcgcggagctgaaaagcgagattgaagaactgaaaaaaattgtcaaaagcctgttaaagtaa

SEQ ID NO: 160 - DNA, 780 bp, Artificial Sequence; identical to SEQ ID NO: 114
  Synthetic: PP-1 GP38

SEQ ID NO: 161 - DNA, 243 bp, Artificial Sequence; identical to SEQ ID NO: 115
  Synthetic: PP-1 GP57A

SEQ ID NO: 162 - DNA, 3654 bp, Artificial Sequence
  Synthetic: WW55 3.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtactccaggagaattgaacgtctatagcaaacaagaaattgaccgtatgtttgttaagaacgttaaaatggttgttccttctggtggtgcaacccgtggttattttaaaattgcatccgcaatgatcccgcagagtggtcggatggcgtttctgcgaatctatggtggtaatggatataatgtaaactcatatgatcaagttgattttcttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgacgtcgcattgactgttcatgatgttcctgaattttcggcgactaaaccagaaaccggaactaaatttgatgctcgtgttattacgatgttcaacaccgaaaacaaagccggaacattgatgtttgataataacaatcagttaacctatgatattgttagccttagcaatggtcctgatgatgttagaaattatctgcgtaaattccgaagtaaagcgggtgaaatgatttggcatgaaaccgttcagggtgctgtatatcgtcttgctactggaactactgattctacggaagttcttagagttgattctaacagtgctctcccgggtagctataaaggatatgtaattactggtaaaatggaattgcacggtagcggtagtgcgatgaatttacaccgccagactggtcaagctgcatatatggcgtggtgggatcgtcgtgatggtaaaaaccaacgtagcggttatatcggtcatgcggatggtactactgatggttttgtgtggcgtaatgatgttggtgcgaactcatttgatttggaaagtagtggacaagtaaatttgactacaggaaaaacaaaaattgtatataccaacggacaatattattccgctaactctgatgcattccgtatgatttacggcaattatggcgcattctggcgaaatgatggtggtaaagtttatctgttgtctactgccgaaaatgatagatttggtggatggaacggcaaccgaccattcatttacgacctgtcaactggtaaagttactttaggtggcgacggtaacgaaggcgcattagttctcgaaagagatagccgtgcggctagatttagcaacagcgtattcttagaaaaaggattgcttactttctctgcgggtgggaatcagtcaatggattctttcacgattaaccattgggggaatagtaacgctggacgatataatgttttacaatttgaagacacgaaaggaacacattttacaaccgaacgtaatgctgatggtggattgcttgctcacttccgaggggatttaaccacagaagggaaattaacgtggggtaagggtacagccacatctagctttaacattcgtgcatggggtaatagtgattcccgtaaacaggttttcgagtgtgtagatgaaagtggttggcattggtatacccagcgaccgggcggtcctggtacttctgcaattgagtttgccatcaatggtactgttaagcctcaagcaattcacactggcggtaatattcttttgaacggtgctgatattgagtttcgtcgcactggtaataagcatttgtggtttagagatccaaacggattagaattgggtttgatttattgtgatgacaacggtgtcattcgttttcgtggtcagaaacaaggtcaagattgggtatttgccaataagatgatccaattagggaccgcttctactgttggtggatctggtaacggtttgattcgcggacaagttcaaggtggtgcttgggcacaatggagagaccgtgctgctggaatccttgtagactgtcagcaatctactgattccgctcataacatctggaaagcgactcattggggaaaatatcatattgcggcaatgggtgtacacgttcctagcggcactataggtaatgctatggcacgtctaaacgtaaatgacgccaactttgactttagcgcctccggtgacatgtcggcagggcgtaacggttcgtttaacgatgtttatattcgttctgatgctcgccttaaaatcaataaggaagagtataaagagaatgccaccgataaagttaatcgcttaactgtatacacctatgacaaggttaaatctttaaccgaccgtactgtcattgctcatgaagttggcattatcgcacaggatcttgagaaagaattgccggaagcagtaacaacctcgaagatcggcgatccagataaaccagaagagatcttaacaatttctaactctgctgtcaacgctcttttaattaaggcgtttcaggaaatgagcgaagaattgaaagccgttaaagctgaactagcggaacttaaaaagtaa

SEQ ID NO: 163 - DNA, 3993 bp, Artificial Sequence
  Synthetic: WW55-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggtgctattatcaatttaagttgtcctcctgtttatgaccgcgatgttacaatggcgggtaaggttaaaggtaataattatatcttaagtaaaaccgctaactatctggaagatcagacagcgagagatcttaactactttggcgctttccgtaccaatggtcttgatggtcttctcgaactcacgctaaacgttcctcactcttccggtgtccaacatggtcgaggatttactttccagtatgggcacactggatcgcgtgtagaaacttatggctataataaagaaggtcaaaaagcatttagttataaaatgtatcacgaaggtgataaaccaactccaggagaattgaacgtctatagcaaacaagaaattgaccgtatgtttgttaagaacgttaaaatggttgttccttctggtggtgcaacccgtggttattttaaaattgcatccgcaatgatcccgcagagtggtcggatggcgtttctgcgaatctatggtggtaatggatataatgtaaactcatatgatcaagttgattttcttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgacgtcgcattgactgttcatgatgttcctgaattttcggcgactaaaccagaaaccggaactaaatttgatgctcgtgttattacgatgttcaacaccgaaaacaaagccggaacattgatgtttgataataacaatcagttaacctatgatattgttagccttagcaatggtcctgatgatgttagaaattatctgcgtaaattccgaagtaaagcgggtgaaatgatttggcatgaaaccgttcagggtgctgtatatcgtcttgctactggaactactgattctacggaagttcttagagttgattctaacagtgctctcccgggtagctataaaggatatgtaattactggtaaaatggaattgcacggtagcggtagtgcgatgaatttacaccgccagactggtcaagctgcatatatggcgtggtgggatcgtcgtgatggtaaaaaccaacgtagcggttatatcggtcatgcggatggtactactgatggttttgtgtggcgtaatgatgttggtgcgaactcatttgatttggaaagtagtggacaagtaaatttgactacaggaaaaacaaaaattgtatataccaacggacaatattattccgctaactctgatgcattccgtatgatttacggcaattatggcgcattctggcgaaatgatggtggtaaagtttatctgttgtctactgccgaaaatgatagatttggtggatggaacggcaaccgaccattcatttacgacctgtcaactggtaaagttactttaggtggcgacggtaacgaaggcgcattagttctcgaaagagatagccgtgcggctagatttagcaacagcgtattcttagaaaaaggattgcttactttctctgcgggtgggaatcagtcaatggattctttcacgattaaccattgggggaatagtaacgctggacgatataatgttttacaatttgaagacacgaaaggaacacattttacaaccgaacgtaatgctgatggtggattgcttgctcacttccgaggggatttaaccacagaagggaaattaacgtggggtaagggtacagccacatctagctttaacattcgtgcatggggtaatagtgattcccgtaaacaggttttcgagtgtgtagatgaaagtggttggcattggtatacccagcgaccgggcggtcctggtacttctgcaattgagtttgccatcaatggtactgttaagcctcaagcaattcacactggcggtaatattcttttgaacggtgctgatattgagtttcgtcgcactggtaataagcatttgtggtttagagatccaaacggattagaattgggtttgatttattgtgatgacaacggtgtcattcgttttcgtggtcagaaacaaggtcaagattgggtatttgccaataagatgatccaattagggaccgcttctactgttggtggatctggtaacggtttgattcgcggacaagttcaaggtggtgcttgggcacaatggagagaccgtgctgctggaatccttgtagactgtcagcaatctactgattccgctcataacatctggaaagcgactcattggggaaaatatcatattgcggcaatgggtgtacacgttcctagcggcactataggtaatgctatggcacgtctaaacgtaaatgacgccaactttgactttagcgcctccggtgacatgtcggcagggcgtaacggttcgtttaacgatgtttatattcgttctgatgctcgccttaaaatcaataaggaagagtataaagagaatgccaccgataaagttaatcgcttaactgtatacacctatgacaaggttaaatctttaaccgaccgtactgtcattgctcatgaagttggcattatcgcacaggatcttgagaaagaattgccggaagcagtaacaacctcgaagatcggcgatccagataaaccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 164 - DNA, 783 bp, Artificial Sequence
  Synthetic: >WW55 GP38
atggcaatatcttctggatgggtaggatcatctgctgtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacaaggatctactccggtagtaattactatcacgggtaatattgtttcccaatctactggcgttccttgtcttgatttccctagctcactgacaaacgaatatgtaacactcattattaactctggtgttcatgtattaggtcgtggaggaaatggcggaagtaactctgctggtggagcaggaggaaatgcaataaataacggaattggaactcgtttaagaataaacaataatggtattattggtggtggcggtggtggcggtgctggtgctagatacaatcctttccctcaaatggatatgaaatttggcggcggtggaggccgtccatttggtgctgcgggtgcggcaggaggcggcgcagcggcagcatctgctggtacaatttctgccccaggtaaaggcactgtttctggggttcattatggaggagatggtggagatttgggagctgctggcaaatcttcatatattaaaggtggtactggtggaactgttcactcgggtggtgctgcgggtaaagctgttactggtaatgcccctcgctgggataaagtaggcacgatctacggtgctcgcgtg

SEQ ID NO: 165 - DNA, 261 bp, Artificial Sequence
  Synthetic: WW55 GP57A
atgtccaatcagcatgaacaaatgattaatgtcctgaaagtacgtctgtttgacactcaagaaaaggccgcattcttagaaggccaactgaaagatcgtgagcgtgtattgatggaactggtacgcattctgggtattcagccagacgaaaacggcactgtttcccttgatgctattgtcgaagaagtgaaagcacttctccctaaagacgaagcagcggaagacgcagaagaggaagtagaactgatcacggaggcttga

SEQ ID NO: 166 - DNA, 3654 bp, Artificial Sequence
  Synthetic: WW34 3.0
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtactccaggagaattgaacgtctatagcaaacaagaaattgaccgtatgtttgttaagaacgttaaaatgtctactccttctggtgaagcaacccgtggttattttaaaattgcatccgcaatgatcccgcagagtggtcggatggcgtttctgcgaatctatggtgggaacggatttaatgttaactcctacgatcaggtggatttccttgaaattgtgattcgtagtggtaataataaccctaaaggcgttagtattgctgcatatcgtcgaaattctttgaacgtccatgaagtatttgcaattaatacttccggtgataactatgacatttatgttaactatggtcgcttcaccgataacgttattgtagagtttggaaaaactgttgatgttgcattgactgttcacgatgttcctgaattttcggcgactaaaccagaaaccggaactaaatttgatgctcgtgttattacgatgttcaacaccgaaaacaaagccggaacgttgatgtttgataataacaatcagttaacctatgatattgttagccttagcaatggtcctgatgatgttagaaattatctgcgtaaattccgaagtaaagcgggtgaaatgatttggcatgaaacagttcagggtgctgtatatcgtcttgctactggaactactgattctacggaagttcttagagttgattctaatagtgctataccaggtagctataaaggatatgtaattactggtaaaatggaattgcatggtagtggtaattcgatgattttacatcgccagactgctcaagccgcgtacatgtcgtggtgggatcgtcgtgatggcaaaaaccaacgtagcggttatatcggtcatgcagatgggactagtgatgctattgtgtggaataatgatattggacaaaacagtgctgttctagaaacatctggtcaaatatctttcagaacaggtgcaaccaaaattgtatataccaacggacaatattattccgctaactctgatgcataccgtatgatctttggtaattacggtgcattctggcgtaatgacggcactaaagtttatcttctttctactgctgaaaatgataagtatggtggatggaatgcctatcgtccattcatttatgatttaacttccggtaacgttcaattaggcggtgatggtaacgaagatgcattaacgttagaatgtgcttctcgtgccgctcgctttagtaatgacgtttacattaagaaagggcttttgactttcgacgctgggcgcgctggatctcgcgattatattcgatttaatcattggggtgatagtaataatgcccgtgataacgttttgtgcatagaagatagtcaaggccgacattttagcacagaacgtgcgatgggtactggtgctcttaaagcatacttcttaggcgatcttgaagtcggtggtaagtttacttggggtaaaaatacagctacatctagctttaatattcgtgcatggggtaatgattcccgtaaacaagtattagaatgcgcggatgaaagtgggtggcattggtacacacaacgaacgggcggtcctgatacttctgcaattgattttgccatcaatggtactgttaggcctcaagcaattcacactggcggtaatatcactatcaacggtgctgatattgagtttaaacgcactggcaataagcacatctggtttagagatccgaacggtttagagttaggcttgatgtactgcgatgatgctggtgctattcgcttccgtggtcagaaacaagcccaggcgtggaaatttgcagataaaatgatccagttggaatctggcactgtatccggtggcggtaatggcctgattcgtggtgaagttgctggcggtagttgggctagctggcgtgaccgtgctgctggtcttatggttgggtgtcctcaatccaccaactcggcacataacgtatggaaagcgacgcattggggtaaatatcacattgcagcaatggctgtacatgttcctgatggtactattaccaatgctttagctcgcctaaacgttcatgacgccaactttgactttagcgcctccggtgacctgtcggcagggcgtaatggttcgtttaacgatgtttatattcgttctgatgctcgccttaaaatcaacaaggaagagtataaggagaatgccaccgataaagttaatcgcttgacggtatacacctatgacaaggttaaatctttaaccgaccgtactgtcattgctcatgaagttggtattattgctcaggatcttgagaaagaattgccggaagcagtaacaacttctaagatcggcgatcctgataagccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 167 - DNA, 777 bp, Artificial Sequence
  Synthetic: WW34 GP38
atggcaatatcttctggatgggtaggatcatctgcggtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacagggatctactccggtagtaattactatcacgggtaatattgtttcccaatctactggagttccttgtcttgacttccctagctcgttaacaaacgaatatgtaacattgatcattaacccaggtgttcatgtttgggggcgtggtggtaatggtggcaataactccgctggtggcgctggtggtaatgcaattaacaacggtataggcacacgcttacgcatcacaaataacggcgctatttgcggtggtggcggcggcggcggcggcgggtattattctcctttttcacaaatgagattaacctttggtggtggcggtgggcgtccgtttggtgctgccggtgggtctgctaatatggaacagggtgctactgctggtactatttccgcgccaggtaaagggtctgtaaacggtgtatataatggcggtaacggtggtgatgctggtggtgctggtggtaaatgtaatatccgtggacagggatcggaatataacggtggtgcggctggtaaggctgttactggcaatgcccctcgctgggataaagtaggcacgatctacggtgctcgcgtg

SEQ ID NO: 168 - DNA, 261 bp, Artificial Sequence; identical to SEQ ID NO: 165
  Synthetic: WW34 GP57A

SEQ ID NO: 169 - DNA, 4956 bp, Artificial Sequence
  Synthetic: WW14-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaccagattattgatttaggctttgcaaagggtggacaagttgacggtgatgtaactattaacggaactctgaatttaaacggccctgaaattgttgcctccggtggttatatagaatttaactatcgtacgacaggtagtggctcttgggcgggtcagcacgcggccaaagctcctatttttgttgatttaagtgcggcgttatctacttcagaatacaacccactgtttaagcagcgttacaaagatggaacattttcagcaggtacattagttactgaaggtagttttaaatttcactatattaatgaagctggtgattcgaaatattggacctttaatcgtaatggtaattttcaagttgataccggtagtttatttgtatcgggtggtaatatttccgcttcaggcaatatcaactctgcctcagggtttgtgtctgcgcctcagattaatactaaaaatattattttagatacaaaagcatttggacaatacgacagtcagtctttagttaattacgtatacccaggcaccggcgaaacaaatggtgtaaactatcttcgtaaagttcgtgctaaatccggcggcactatgtggcatgagctttgcactgcccaattaggccaagccgatgaaatgtcttggtggacaggtaatacccctcagtctaaacaatacggtgttcgtaacgacggccgtttgattggtagaaatagccttgcattaggtactatgactaccgatttcccatctagcgattatggtaataccggagctatgggtgacaaatacctagttttaggtgatactgcaaccggtttaaaatatatcaaacaaggcaattttgatttagttggtggtggatattctgttgcgtcaattaccacagacggtttccgtggcacaagtaaaaccttatttggtcgtagtaatgaccaaggtttaacatggcttcttcctggtcaaaactctgcaatggtttctatcagaaccgaaatagatggtaataactctggcgatggccaaacccatttaggttataattctaatggtaaactttatcattatttccgtggtaccggtcgtgtagccatttctatggcagaaggtatgattattgaacctggtattttaaatattaagaccggggttaacgaattaaatcttagagcagacggcacagtttctactacacagcgtttaatggttaataacggcttagttcttaacgcaaacaataatacttctgcattggcattaactgctcctaccggtgttgatggtacaaaaaccattaactgggacgctggtacccgaaatggccagaacaaaaataccgttaccatgaaagcatggggtaactcatttaacgcgggtggtggtaatagagaaactgtattcgaagtatcagattcacaaggatattatttctatggccaacgtactaatccggcttccggtgaaactgtaggccctattaacttcaagttcaacggttctgttgaaacaggtcatttttctagtctcggaaatataagtgcatctggtaccggttcttttggtggcaatgttaccatgactaatggcctgtttgtccaaggcggcgcttcaattaatggccaagttaaaatgggtggtactgctgacgcattaagaatttggaacgctgaatatggtatgattttccgtcgttcagaaacgggttcttctgcttcattccatcttattcctacccttcaaaacgccggtgaaaatggcggaataagtgaccttcgtccactatctatcaatttagctagcggcacggttataatgggtaataaaagcacaggtggcccacttttcacagtagacaacgtaagtaaatttgttcaaaccgactgtagattgcgtgttaatatggattctgatggtattgttttgaatgcttcatctcaagcagcatccaactttattcaaggacgtaaagcagatgttacaaaatggtatctaggtattggcgatggtggcaacgtcgttcgtatgcacaactatacttattcacatggtattgcattaaactctgataccgttgatataaccaagcctcttaaaataggttctgatattcgtatcggtactgatgggaatattataggcagtgctactttagataactttaaaaacctgaatacaacattagaccataaagttaatatgggcggttggtccggcggtgctactacaggttggtataaatttgctactgtagaaattccacaggcaacaggcacggcatcttttaaaatatttggcggttccgggtttaattttaaaagttacggtcaggcttcaatagctgaaataattcttagaaccggtaataataaccctaaaggccttaatgccacgttgtggaataggacttctgaagctatttcccagattgcttcggttaatacaagcgaagatatctatgatatttacgtttacttaggtgggtattctaattctttggtggtagaatatacctgcagcagcaatagtaaagtaaccgtagtaggtatggatggtggtgtccagcctttggtagaaacattacctgaaggtcatgttgtaggtaaatctgtaagaatgctgaacaaccttgacggaatgtttgccgctggcgaatcggatattgttactcgtggtgaatatgttaccaataaccaaaaaggtatgcgtattaaatctaaaggtaatgatttagattctaatgctgctttacttagaaacgacggtggaagtttttatattttagctacagataaaaatacgacagaaaaacccgatgcggctaatggtgattggaatggcttaagacctttctcgattaatatggctgatggtcgcgttggtatgaaccacggattgaatattactggcggtggtctgaacgttaccggcggtaatactaaccttggtaatattacatctcgtgtagtttcttcggcacgcgccgggtccggttggggtgataactctgatgctatgaaatccaaaattacctttatggctgaccacggtgatttatctaattcaggcagttattatcctatcgtaggcgcatacagcaactatggttcagcgggttatcgtcaaacctttgaatttggatgggtcggctctggtagcaccgcaaattggcgagaaggtattattcgtattcgcggtgataatgctaacggccagcaagcaagatggcgctttacaatggacggtattttaggttgccctggtaaagtagagatgccagaaacaagcgcatttggtatcaacacaacaaatggatttggtggtaactcgattgtaattggtgatagcgatactggttttagacaagtcggtgatgggcttttagaagtttggactaacgcctcacgccgaatgagattccaaggcggtgatacctattcagatatgaatattaacgccccgaacgtttatattcgttctgatattcgtttgaaatctaacttcaaaccgattgaaaatgctcttgataaggttgaacagctagacggtttaatctatgataaagctgattatattggcggcgaagttgttcataccgaggccggtgttattgctcagagtttggaaaaagtattgcctgaagctgtccgtgaagttgacgacattaaaggtaacaaagttcttaccgtttcaacccaggcacaagttgctctgttaattgaagcagttaaaactctgtcggctaaagttaaagaacttgaagcaaaacttaattaa

SEQ ID NO: 170 - DNA, 789 bp, Artificial Sequence
  Synthetic: WW14 GP38
atggcaattgtaggtgttcctggttggattggacaatctgccgtagatgaaacgggacaacgttggatggatgccgctatgcgcgatgtgcgagttgcagtacccggttggatggggtcgatggcaggacaatcaaaagaaatttatctatctataggggctaataactcttatgatagaaactcccttattaactggatgagggctcaaggtggcgcgcctgtagttattacaatcaccggtaacttagtatccaatagcaccggtaacgcttgtttggaatttcctagcaatcttcctaacgcgtatattcaacttatcattaatagcggtgtgactgtttatggccgaggaggtaatggttctactaatggttcggcaggtggaaacggtggtacagctatccataacgcagccggaactaaactccgtattcgtaataacggcgctattgccggtggtggtggtggcggtggcgcagtatcattgcaaaatagctacccgactaatggtacatgcggtggtggtggtggtagaccatttggcgtaggtggtaaaataggctctgacgctatattgtccggttcgaatgcgtctttaacagctgccggtacaggtggtgctacagtccaatatggtggaggtaatggcggtaacgttggagctggcggtggacgaggatggggcaaaaatgtttatacctctgcaggtggctcagctggtgctgctgtcactggcaatgctcctaactggcaaaacgtaggaactatttacggctcaagagtctag

SEQ ID NO: 171 - DNA, 231 bp, Artificial Sequence
  Synthetic: WW14 GP57A
atgtctgaacaaactattgaacaaaaactgcaagccgaaatcgtagctcttaaatcccgcattctggacacccaggatgttgcagctcaagctcaacaggaatcacgtattctgcaggatgcgctgagtaaaatcgctgctcgcttaggcatcaccggtgaccagattcagattgaagacctgattgccgctgttcctgatttgaccgctgaaagtgctgacgaagaataa

SEQ ID NO: 172 - DNA, 3978 bp, Artificial Sequence
  Synthetic: WW170-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtggtgctattatcaatttaagttgccctccggtgtatgaccgcgatgttacaatggcgggtaaggttaaaggaaataattatattttaagtaaaaccgccaactatctggaagatcagacagcgcgagatcttaattactttggtgctttccgaactaatggacaagatggtcttttagatctaactcttaatgttcctcattctgctggcgttaatcatggtcgaggatttactttccgttatgcgactggcggatctcgtgttgaaacctatgggtataatgcacagggacaaaaagcatttagctataaaatgtatcatgaaggtgataaacctaccccatcggaattgaacgtttatagcaaacaagaagttgaccgtatgtttgttaaaaccgttaaacttgctacagttcctgttgatatcgttgacggttattttaaattagcaactgcgatgattccgcaaaacggtcgtagcgtatttttccgtattcatggtggtaacggatataacgttactgcatacgatcaagttgatattgtagaaattgttattcgcagtggaaataatcgtcctaaaggtgttaacgttattgcataccgccgaaatacaaacaaagcatttgatgttttggctgttaatacttctggtgataactatgatatctacgtgaaatatcagcgttacactgataacgttattgttgaatttggtaaaagtgttgatgttgatctggtagtccatgacgttccagactttgttgttgatcgtcctgttggcgataatgttattggcggtcgcgcggtaactcttttcaacaccgaaaacaaacgaggtgtgttgagttttgacgataacacacaaaatagttatgatattgttcacttgagtaatgataggggtactggacgaaaatatattcgtaaattccgtagcaactataacgaaatgatctggcatgagacggttcaaggttctacttatcgactcgccacgggtagcacagatgcccaggagattctatccgttgaatctagtagctctattgctggaactcataaaggtaatattctttctggtcgaatgatgttgggtggcggtagtaatgttattaccttgcggcgtcctgctggtcaatccaaccatattgcgtttcaagataatcgtactggatctattacccgtcaagggtggatcggttatggtaatgctgatactaacgtttttgaatggtatagtgatgtaggtggtacttctattcgtcaccacatcgacggacagatcgaacttgcaaccggtaacacaaaacgcgtttatactaacgctcaattcatctcaatgaatagcgacgcctaccgtatgatctttggtaattacggtgcattctggcgtaatgacggcactaaagtttatcttctttctactgccgaagatgataaatttggcgggtggaatggaaacagaccgttcatttacgatttgaccaacggtaaagttactttaggtggtgatggtaacgaaggtgcattagttctcgaaagagatagccgtgctgctcgatttgctggtgatgtttatgtagaaaaaggatttcttcatttttctagtgggcgtcagggtgctagcggtttcatgaaaataaaccatttgggtgatattgccagtggacgacacaacattcttcaaatagaagaccctacaggtatacatttctctactgaacgcaatgatgaaaccggaaatattactgcacgttttaaaggctttgtacgtgtagaagctggtgaaattgcatttgatgctaatcgggggtcgcagtctcaatttaccttacacacatggggtaacgagcaacgcaaacaggtttttgaatgtaaggatgctacaggttatcactggtatactgaacgtactcagggtggcactggaaatgttctgttctctatggctggtagtctaaacgttactagcaatatcacaacaactggtgctgatattacgtttaaacgcgctggcaataagcacatctggtttagagatccagacggtttagagttgggcttgatgtattgcgatgatgctggtgctattcgcttccgtggtcagaaacaagcccaggcgtggaaatttgcagataaaatgatccagttggaatctggtactgtatctggtggcggtaatggcctgattcgtggtgaagttgctggcggtagttggtctagctggcgtgaccgtgctgctggccttatggttgggtgtcctcaatccaccaactcggcacataacgtatggaaagcgacgcattggggtaaatatcacattgcagcaatgggtatacatgttcctgacggtactatcggtaacgctcttgctcgtctccatgttcatgatactaactttgactttagcgcctccggtgatatgacggcaggtcgtaacggttcgtttaacgatgtgtatattcgttctgatgctcgccttaaaatcaataaggaagagtataaagagaatgccaccgataaaattaatcgcttgacggtatacacctatgacaaggttaaatctttaaccgaccgtactgtcattgctcatgaagttggtattattgctcaggatcttgaaaaagaattgccggaagcagtaacaacttctaaggtcggcgatcctgataagccagaagagatcttaacaatttctaactctgctgtcaacgctcttttaattaaggcgtttcaggaaatgagcgaagaattgaaagccgttaaagctgaactagcggaacttaaaaagaattaa

SEQ ID NO: 173 - DNA, 780 bp, Artificial Sequence
  Synthetic: WW170 GP38
atggcaatatcttctggatgggtaggatcatctgcggtgtccgagactggtcaacggtggatgagcgccgcaatgcaagctgtacgcttaggtcgtccggcgtatatgtcggcaatggtcggacgctctaaagagattcattatagcattggtgctagtaactcttacaataaagacactcttattaactggatgaaagcacaaggatctactccggtagtaattactatcactggtaatattgtttcccaatctactggcgttccttgtcttgacttccctagctcgttaacaaacgaatatgtaacattgatcattaaccccggtgttcatgtttgggggcgtggtggtaatggtggcaataactccgctggtggtgctggtggtaatgcaattaacaacggtataggcacacgcttacgcatcacaaataacggcgctatttgcggtggcggtggcggtggcggcggtgggtattattctcctttttcacaaatgagattaacctttggcggtggtggtgggcgtccgtttggtgctgccggtgggtctgctaatatggaacagggtgctactgctggtactatttccgcgccaggtaaagggtctgtcaacggtgtatataatggcggtaacggtggtgatgctggtggtgctggtggtaaatgtaatatccgtggacagggatcggaatataacggtggtgcggctggtaaggctgttactggcaatgcccctcgctgggataaagtaggcacgatctacggtgctcgtgtgtaa

SEQ ID NO: 174 - DNA, 261 bp, Artificial Sequence
  Synthetic: WW170 GP57A
atgtccaatcagcatgaacaaatgattaatgtcctgaaagtacgtctgtttgacactcaagaaaaggccgcattcttagaaggccaactgaaagatcgtgagcgtgtattgatggaactggtacgcattctgggtattcagccagacgaaaacggcactgtttcccttgatgctatcgtcgaagaagtgaaagcacttctccctaaagacgaagcagcggaagacgctaaagaggaagtagaactgatcacggaggcttga

SEQ ID NO: 175 - DNA, 3948 bp, Artificial Sequence
  Synthetic: WW202-G8
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtgggcaaattgttaatttaagttgccctcctgtttatgacaaaggctttgatgtaagaggccgcgtggttgtggatgaccttgtgtggagtaataccgcaaactatttcgatgacccgaccgcacgaaatcttgataaatttggggcatttcgtactaatgatatggatggtcatctagcatttgctttgcatattccccatcctagcggtataaatcatgctcgtgggtttgattttacttatggttctaacgttgttcctactgtaaaaacctatggttataacgctgatggtgtattggcatattcatatcgcatgtatcacgaaggtgataagcctagtccgtcagaattaaatgtatacagcaaacaagaagtagatcggatgttccaaaaaaccatcaactttggtgtagaaactggatggtttaaaattgctacagcatttattccgcaaaatgatggacgtagcttgaaaattagattggttggtggaaatgggtggaacgtaggccaaacgggacaatgtaatattattgaacttgttataaggactagcaacggttcccctaaaggaattaactttgttgcatatcatcatgtttctggttacgaaaatcaattttgtgccattaatacaggtgatgacacttatgatatctatgcatactactacgaatttactaatatggtaatggctgaatatcaagcgtccagcgatgttaatttaactgtatttgatcgacctgaatatgtaggcgaaaaacctgtagccgaacatatattcgatgcatatacaatacactcctttaacagtttcagtaaccgtggaacattaaattttgctggcaaccatcaaggacaatatgacattgagcatatgaacgaacaaccgacaaatgctaaaaagatgttgcgtcggtttcgaagctctgccagcgcgacaatctggcatgaaaccgttgatgaccagaattatcgtcttgccactggaggtacagactcagttcaacaattattgttgtcttctgggactggtttgcatattcgtagattgaccatcgatggtggcttaggttccggttctaatgctggtattgatattcgtcgaggaccaaacgaatcaagccattttaattttatggattatcgcactggtcaagatgttcgtaatggttggtttggttttggtgatttgacgaccaaagattttatttggtggaacgataacggtcaaaactcgataaacttgatcgaaaacggtgaattacatattactggcggtagaggccagaaaattgtaatgaatagcgaagttgcattatctgaaaatgctcgtttggctgtcaaaggtggtaactatggtttaatccttcgtaatgatgggactggtttccatatactgactaccgatttaaaagattcttttggtagttggaataatcgcagaccattcagctataattttgcggacggtggattatatttaggtggtactgaaactgctcgttgtttgcatcttggaattgatggtagcactcgtctagaagacaaccttttctttaaagctggttctcgtcaatctatggactatatggaactcgtccattggggggcaagcaatacaggtcgaaataacgttttaagtcttcgtgactcaaaaggatttttagcagaatttgaacgcgtgggggggactgacggcgttaaaaccagattctttggcgaaacattcactgacggtacattatacctaaatcagatgaataatagctctgaacgattctctatcaataactggggaaattcagaagttggtcgcgcggcagtaatggaagttggcgattccaaaggttatcacttctatgcggaacgtagaacagatgacaccgttttatttgatgtatctggtgctttgaccgtgcatggacctaacggaataaccgtcaaaaactcaactggtgcacgccatatctggtttagagatgatagcgatacggaaaaggctgttatctgggctacagatgatggtatgttacatatacgaaataatcatgagggttcatttgctcatcacttccagggcgcaatgattaaactggaagggcgtgttccttatggtgcagcaaaagggcttattcgaggcgaggtagacggtggtgcatatgttgcatggagagatcgccctgctggtttgttggttgactgccagaaaagtattgacagtgctcatgctgtttggaaagcggttgattgggggcgtcaatatatcgctgctatggacgttcattgtccgggtgatggtaataatactgcggcagcggttcttcatgttcaggctgctgattatcaattccatgcaagcggagaatttcatgcctctggtaacgggaactttaacgatgtgtatattcgttcagaccgtcgccttaaagacaatatagaagattatacaggaaatgcgttaagtttgatcggcaaactgaaagtgaaaacttacgataaagttaaatctcttaaagaccgtgaaattatcggtcacgagatcggcattatcgcacaggatttacaagaaatattaccggaagctgtaaaatcttcaaaagttggcaatcttgataatccagacgatgttctgacaatttctaactctgctgtgaatgctcttttaattaaggctattcaggaaatgagtgaagaaattaaagaattgaaaactcctttctttactaaaattgctcgcaaaattagtaaatattttaaattctaa

SEQ ID NO: 176 - DNA, 783 bp, Artificial Sequence
  Synthetic: WW202 GP38
atggcagtagttggtgttcctggttggattggaagttcagccgcaaatgaaacagggcaacgatggatgagtcaagcggctggtcaattaagattgggtgttccttgctggatgagccaattctccggtcgttcaagagaaattattcatacacttggagcagaccataacttcaatggtcagtggttccgtgatagatgctttgaagcaggtagtacacctatagtgtttaatatcaccggagatttagtatcatattctaaagatgttcctttattctttatgtacggagatacacctaatgaatatgttcagttgaatatacatggcgtaacgatgtatggtcgtggcgggaatggcggtagcaatagtcctggatcagctgggggtcattgtattcaaaatgatattggtgggagactaagaattaataatggtggagctattgcaggtggcggtggcggtggcggtggcgggtattattctcctttttcacaaatgagattaacctttggcggtggcggtgggcgtccgtttggtgcacccggcggatctattgatatgcaatcaggcgcaactgctggtactctttatgctcctggatcggggtccgtgaacggtatctataatggcggaagcggtggtgaggtaggcgccgcaggaggtagatgtaatattcgtggtcaaggatatgaatacaatggcggcgatgctggttatgctgttataggttcttctccaacgtggcaaaatcgcggagctatttacggacctgctgtttaa

SEQ ID NO: 177 - DNA, 261 bp, Artificial Sequence
  Synthetic: WW202 GP57A
atgtccaatcagcatgaacaaatgattaatgtcctgaaagtccgtctgtttgacactcaagaaaaagccgcattcttagaaggccaactgaaagatcgtgagcgtgtattgatggaactggtgcgtgttctgggtattcagccagatgaaaatggcactgtttcccttgatgctatcgtcgaagaagtaaaagcacttctccctaaagacgaagcagcggaagacgctaaagaggaagtagaactgatcacggaggcttga

SEQ ID NO: 178 - DNA, 7300 bp, Artificial Sequence
  Synthetic: p7.3 (p513)
cctttagggaaatatgctaagttttcaccgtaacacgccacatcttgactatatatgtgtagaaactgccggaaatcgtcgtggtattctgaccagagcgatgaaaacgtttcagtttgctcatggaaaacggtgtaacaagggtgaacactatcccatatcaccagctcaccgtctttcattgccatacgaaactccggatgtgcattcatcaggcgggcaagaatgtgaataaaggccggataaaacttgtgcttatttttctttacggtttttaaaaaggccgtaatatccagctgaacggtttggttataggtgcactgagcaactgactggaatgcctcaaaatgttctttacgatgccattgacttatatcaactgtagtatatccagtgatttttttctccattttagcttccttagcttgcgaaatctcgataactcaaaaaatagtagtgatcttatttcattatggtgaaagttgtcttacgtgcaacattttcgcaaaaagttggcgctttatcaacactgtccctcctgttcagctactgacggtactgcggaactgactaaagtagtgcgtaacggcaaaagcaccgccggacatctgcgctagcggagtgtatactggcttactatgttggcactgatgagggtgtaagtgaagtgcttcatgtggcaggagaaaaaaggctgcatcggtgcgtcagcagaatatgtgatacaggatatattccgcttcctcgctcactgactcgctacgctcggtcgttcgactgtggcgagcggaaatggcttacgaacggggcggagatttcctggaagatgccaggaagatacttaacagggaagtgagagggtcgcggcaaagccgtttttccataggctccgcccccctgacaagcatcacgaaatctgacgctcaaatcagtggtggcgaaacctgacaggactataaagataccaggcgtttccccctggcggctccctcgtgcgctctcctgttcctgcctttcggtttgccggtgtcattcctctgttacggccgagtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggataaggctaaactgaaaggacaagttttggcgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcactttatagctagctcagcccttggtacaatgctagcgttttcattaaagaggagaaaggaagccatgagtaaaggtgaggaattatttactggtgttgttccgatcttagttgaactggacggcgatgttaacggtcataaattcagtgttcgtggtgaaggtgaaggtgatgcaaccaacggtaagctgaccctgaaattcatctgcactactggaaaattaccagtaccgtggcctactctggtgactaccctgacctatggtgttcagtgtttttctcgttaccctgaccacatgaagcaacatgatttcttcaaatctgcaatgccggaaggttatgtacaggagcgcaccatttctttcaaagacgatggcacgtataaaacccgtgcagaggttaaatttgaaggtgacactctggtgaatcgtattgaactgaaaggcattgatttcaaagaggacggcaatattttaggccacaaactggaatataacttcaactcccataacgtttacatcaccgcagacaaacaaaagaacggtatcaaagctaacttcaaaattcgccataacgttgaagacggtagcgtacagctggcggatcattaccaacagaacactccgattggagatgctcctgttttactgccggataaccactacctgtccacccagtctaaactgtcgaaggatccgaacgaaaagcgcgaccacatggtgttattagagttcgttaccgctagtggtatcacgcacggtatggatgaactctacaaataagtcagtttcacctgttttacgttaaaacccgcttcggcgggtttttacttttgggtttagccgaacgccccaaaaagcctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaagaacctgtaaagtgataatgattatcatctacatatcacaacgtgcgtaaagggactataacaagacgcaaacggaggtaggctcactcctacttcggaaacttaaccgaagaactaggacggtattgtttgcgcttggaattggccttgaagtaagtcaggttttgacggaacgattagttacagggggggaacagtcgttggtcgccaccaagtcgatttttggcttacctcttatctcgtagttggtgagggttgggattcacgggacgagatccagcctaagtatattgtcacttctgattcgttcgatcacttactccccttacttatcctgcggctactgtttccgctggctcgtaagctctacgttcggcaatctacccgcgaggtcagacgtgacactcttaaactaaaaattggtagcttctttggctgaattgctggatcttattcgttcacccaataaaacggtacagcttcaagcaatatcctcagtaagttaatacccgttgtactattactttcacgaccgttcgacgttcccgctctatttattaagagctgtcacttcgagtctttagctcacttaggaattagctgagtttaggctcagccctcttgggttgcttgtactttcagagttattcgcacggctggttttgtcgagtggggaattgtggttgaccgaaagtccgctatccttcaacgccgaatcagctcttgccctttactatcttcaatctcttggaggctattacgggcgggggcaagagattagaactgcaagacacccgttgataatcgagtcgctcgatagattgtcgagagccggagagattagtacgttattcaaggcaatacgtgcagggttaatctgggcgcgttgtagtctacgctggcgtaagtccccaataacacgctcgtccggcgagtcacgatcctctaggcggtgttcaacgcgtacgccagctatttgggatacttagctacgttacacgtaagaatatcttagcggaggatcgccctgcttccgcttggacggataaacgggagagtgggcgcgtatagcgcaggcggtgtgaaggcttttaagtaattctagccctctttgaacggtatttcccaatttggagattaccggatagcgcgtttaaatgagtgtcagagaaacggaagccgaagtctttccattccggatgtttggaaatgctctgtttatagaagtcgatgaacttacggcagtcctctatattaaattcgaatttttcataccctttctgcgggctaccgtttttagtgtgcgtgctatgattgcggatgcgcagaatatcctcagacgggttgtagaatttgatgcttttcgcggaaaagaacactttcggtaacattttattcgcacccggcaggagcttgtacacgattttcttatagccttcacccttgttttctttgatcgctttatcgtcgaagatcttgttgttcttcttgttcattacgcccagatagtatttgtcgtctttgatgaacaggattgcggtgttgtccggctctttgttcttatcccagccgttcgccagcgtgctgttttcgaagttcagtttgaatttctcgtcagagtaaggcttctgcgtgatgtagttgcggattttattgtagagagggacgatgtttgccagttcgaagtaacattcttcgaacaccagatagaagtgttcatctttatccagaatgttcgccttgtcctcgctctggctgatgtggaagattttgagcttgtgtaataagttattcgtctgatctaataagtctttaattgctttcacatcgtcctccgcagatgcttgaagcagatctttcttaccctgattctggtacttgatagagatctgcgccagattgtctttgttttgagcaatttcgtcgaagatcatcgggattgccgcaaagttcgccagaatttcctcaaaacgacactgtttatcaatatcacgatgtttattaaattcctcaagtgccagtttgatagtttctaagctcaggtatttagctttttctgttttctttgcaatcagttcctgttccttcttggacgggttgtccagatttttcggcgcgatttgttgggtgatgtattccaaaactgccgtgccgatcacgctatagtcatcgaaaacttgttgactgagatcggtcagagatttgtcgtttttaaagtaaatcttagacagatctagtttctgcgctttgaggtcgtcaaagagcagggacagagtttctttaatagatttctcttccacggttttgaacgccgcaatctgctcataaaagctctgcatcgtggtgacaacgtcgctatcatcttccagtttatcaattacgaaggatttagattcggtgtccgataaaatctgtttaaacagaacggacattttatactttttcagggttttgtcgttgatttgttggctatacaggttaatgtattcgttgatgcccttacgcttggtgttttcgccgttaacaaatttgccaccaataatggtgttgaatttggtgatgccagattgattcaggtaattgttgaaattagcgatttcgaaaacctcgtccagtgagaaaacacgctggttaacttcggaggttttatagtcgatgtcgaaggtcagttcttccgccagatctttcttgatctgttcatagttaatagcttccggtgctttgtctttcagagattcatatttcgctttgttttccagaaacttcggcaggttgtcgtccacgatacgataaataatagaggtcggaatatcgttgctcgaatatacattcttacggttttcatgaaaacctttgaaatacgtcgtccagcctttgaaagacttgatgatttcggtattcgaatatgacctgatcaaagataaacgtttcaccgaagataagttctttttccactgtccgattaccatcaacttcaaatctagcggtgcgaacaagttcaacgatgaaattaacttattactgaaagagaaagctaatgacgtacacatcttatctattgatcgcggtgaacgtcatttagcatactatacactggtagatggtaaaggtaatattattaaacaggatactttcaatattatcggtaatgaccgtatgaaaaccaactatcacgataagctggcggcgatcgaaaaagatcgtgattctgcgcgtaaagattggaagaaaattaacaatatcaaagaaatgaaagaaggctatctgagccaagtggtgcacgagatcgcaaaactggtgattgaatataacgctatcgtggttttcgaagatctgaactttggttttaaacgtggtcgcttcaaagtagaaaaacaggtgtaccaaaaactggaaaaaatgctgattgaaaaactgaactatctggtttttaaagacaacgaatttgacaaaacgggtggcgtactccgtgcctatcagctgaccgctccgttcgaaacgttcaagaaaatgggtaaacaaacggggattatctattatgtgccagctggtttcacctccaagatttgtccagttacgggcttcgttaaccagctgtacccgaaatacgagagcgttagcaaatctcaagaatttttcagcaaattcgacaagatctgctataatctggataaaggctatttcgagttcagcttcgattacaaaaacttcggcgataaagcggctaaaggtaagtggactattgctagctttggtagccgtctgattaactttcgcaactccgacaaaaaccataattgggacacgcgtgaagtgtatccgaccaaagaactggaaaaattactgaaagactattccggacactcagaagggttataggaatagtcactactggggtaagcacttcggaaattatattattctcgcttcttattgcggtaacgtgatcctgaacgatacttattactttgtaatttacttaacgtcggagtccctgcaatcttctagtacccgcttcccgaatacaggagataactttttaacactcaagagttgcttcgtgcttagccagtcttggatttgattgctctaatccttcaacgtgtcaaagacagtgtatctggtcaagtaaagtctagagaaaggcgtagtcagttacggagttatcccaccttagtgttactccgatttaatttctgctttctttgatttctacccgactttcgccgtgacttcaatagagaggcaggctcttgctatttctttcaagggcttgtccaactacctaattaagataaagatacggcagttgacgcactgccgataatttctttacgtcagcgaaattaaatcgagcaccagtcgtagagtcgcggttgcctagcagtttatctcgcgtacgggccttcgctacttacacgatacctagtacgtggattcgggtagcaccagaagtctatagcatgtgcatacctttggtcgaaaaaaaaagcccgcactgtcaggtgcgggcttttttcagtgtttccttgccggattacgccccgccctgccactcatcgcagtattgttgtaattcattaagcattctgccgacatggaagccatcacaaacggcatgatgaacttggatcgccagtggcattaacaccttgtcgccttgcgtataatattttcccatagtgaaaacgggggcgaagaagttgtccatatttgctacgtttaaatcaaaactggtgaaactcacccagggattggcactgacgaaaaacatattttcgataaac

SEQ ID NO: 179 - DNA, 3396 bp, Artificial Sequence
  Synthetic: 1A2
atgggtaaaggaagcagtaaggggcataccccgcgcgaagcgaaggacaacctgaagtccacgcagttgctgagtgtgatcgatgccatcagcgaagggccgattgaaggtccggtggatggcttaaaaagcgtgctgctgaacagtacgccggtgctggacactgaggggaataccaacatatccggtgtcacggtggtgttccgggctggtgagcaggagcagactccgccggagggatttgaatcctccggctccgagacggtgctgggtacggaagtgaaatatgacacgccgatcacccgcaccattacgtctgcaaacatcgaccgtctgcgctttaccttcggtgtacaggcactggtggaaaccacctcaaagggtgacaggaatccgtcggaagtccgcctgctggttcagatacaacgtaacggtggctgggtgacggaaaaagacatcaccattaagggcaaaaccacctcgcagtatctggcctcggtggtgatgggtaacctgccgccgcgcccgtttaatatccggatgcgcaggatgacgccggacagcaccacagaccagctgcagaacaaaacgctctggtcgtcatacactgaaatcatcgatgtgaaacagtgctacccgaacacggcactggtcggcgtgcaggtggactcggagcagttcggcagccagcaggtgagccgtaattatcatctgcgcgggcgtattctgcaggtgccgtcgaactataacccgcagacgcggcaatacagcggtatctgggacggaacgtttaaaccggcatacagcaacaacatggcctggtgtctgtgggatatgctgacccatccgcgctacggcatggggaaacgtcttggtgcggcggatgtggataaatgggcgctgtatgtcatcggccagtactgcgaccagtcagtgccggacggctttggcggcacggagccgcgcatcacctgtaatgcgtacctgaccacacagcgtaaggcgtgggatgtgctcagcgatttctgctcggcgatgcgctgtatgccggtatggaacgggcagacgctgacgttcgtgcaggaccgaccgtcggataagacgtggacctataaccgcagtaatgtggtgatgccggatgatggcgcgccgttccgctacagcttcagcgccctgaaggaccgccataatgccgttgaggtgaactggattgacccgaacaacggctgggagacggcgacagagcttgttgaagatacgcaggccattgcccgttacggtcgtaatgttacgaagatggatgcctttggctgtaccagccgggggcaggcacaccgcgccgggctgtggctgattaaaacagaactgctggaaacgcagaccgtggatttcagcgtcggcgcagaagggcttcgccatgtaccgggcgatgttattgaaatctgcgatgatgactatgccggtatcagcaccggtggtcgtgtgctggcggtgaacagccagacccggacgctgacgctcgaccgtgaaatcacgctgccatcctccggtaccgcgctgataagcctggttgacggaagtggcaatccggtcagcgtggaggttcagtccgtcaccgacggcgtgaaggtaaaagtgagccgtgttcctgacggtgttgctgaatacagcgtatgggagctgaagctgccgacgctgcgccagcgactgttccgctgcgtgagtatccgtgagaacgacgacggcacgtatgccatcaccgccgtgcagcatgtgccggaaaaagaggccatcgtggataacggggcgcactttgacggcgaacagagtggcacggtgaatggtgtcacgccgccagcggtgcagcacctgaccgcagaagtcactgcagacagcggggaatatcaggtgctggcgcgatgggacacaccgaaggtggtgaagggcgtgagtttcctgctccgtctgaccgtaacagcggacgacggcagtgagcggctggtcagcacggcccggacgacggaaaccacataccgcttcacgcaactggcgctggggaactacaggctgacagtccgggcggtaaatgcgtgggggcagcagggcgatccggcgtcggtatcgttccggattgccgcaccggcagcaccgtcgaggattgagctgacgccgggctattttcagataaccgccacgccgcatcttgccgtttatgacccgacggtacagtttgagttctggttctcggaaaagcagattgcggatatcagacaggttgaaaccagcacgcgttatcttggtacggcgctgtactggatagccgccagtatcaatatcaaaccgggccatgattattacttttatatccgcagtgtgaacaccgttggcaaatcggcattcgtggaggccgtcggtcgggcgagcgatgatgcggaaggttacctggattttttcaaaggcaagataaccgaatcccatctcggcaaggagctgctggaaaaagtcgagctgacggaggataacgccagcagactggaggagttttcgaaagagtggaaggatgccagtgataagtggaatgccatgtgggctgtcaaaattgagcagaccaaagacggcaaacattatgtcgcgggtattggcctcagcatggaggacacggaggaaggcaaactgagccagtttctggttgccgccaatcgtatcgcatttattgacccggcaaacgggaatgaaacgccgatgtttgtggcgcagggcaaccagatattcatgaacgacgtgttcctgaagcgcctgacggcccccaccattaccagcggcggcaatcctccggccttttccctgacaccggacggaaagctgaccgctaaaaatgcggatatcagcggtaacgtgaatgcgaactccgggacgctcaacaacgtcacgattaacgagaactgtcgggttctgggaaaattgtccgcgaaccagattgaaggcgatctcgttaaaacagtgggcaaagctttcccccgggactcccgtgcaccggagcggtggccatcaggaaccattaccgtcagggtttatgacgatcagccgtttgaccggcagattgttattccggcggtggcattcagcggcgctaaacatgagaaagagcatactgatatttactcctcatgccgtctgatagtgcggaaaaacggtgctgaaatttataaccgtaccgcgctggataatacgctgatttacagtggcgttattgatatgcctgccggtcacggtcacatgacactggagttttcggtgtcagcatggctggtaaataactggtatcccacagcaagtatcagcgatttgctggttgtggtgatgaagaaagccactgcaggcatcacgattagctga

SEQ ID NO: 180 - DNA, 2325 bp, Artificial Sequence
  Synthetic: >WT STF
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggcctttccggcaggtgcgccgatcccgtggccatcagatatcgttccgtctggctacgtcctgatgcaggggcaggcgtttgacaaatcagcctacccaaaacttgctgtcgcgtatccatcgggtgtgcttcctgatatgcgaggctggacaatcaaggggaaacccgccagcggtcgtgctgtattgtctcaggaacaggatggaattaagtcgcacacccacagtgccagtgcatccggtacggatttggggacgaaaaccacatcgtcgtttgattacgggacgaaaacaacaggcagtttcgattacggcaccaaatcgacgaataacacgggggctcatgctcacagtctgagcggttcaacaggggccgcgggtgctcatgcccacacaagtggtttaaggatgaacagttctggctggagtcagtatggaacagcaaccattacaggaagtttatccacagttaaaggaaccagcacacagggtattgcttatttatcgaaaacggacagtcagggcagccacagtcactcattgtccggtacagccgtgagtgccggtgcacatgcgcatacagttggtattggtgcgcaccagcatccggttgttatcggtgctcatgcccattctttcagtattggttcacacggacacaccatcaccgttaacgctgcgggtaacgcggaaaacaccgtcaaaaacattgcatttaactatattgtgaggcttgcataa

SEQ ID NO: 181 - DNA, 585 bp, Artificial Sequence
  Synthetic: >WT STF accessory protein 1
atggcattcagaatgagtgaacaaccacggaccataaaaatttataatctgctggccggaactaatgaatttattggtgaaggtgacgcatatattccgcctcataccggtctgcctgcaaacagtaccgatattgcaccgccagatattccggctggctttgtggctgttttcaacagtgatgaggcatcgtggcatctcgttgaagaccatcggggtaaaaccgtctatgacgtggcttccggcgacgcgttatttatttctgaactcggtccgttaccggaaaattttacctggttatcgccgggaggggaatatcagaagtggaacggcacagcctgggtgaaggatacggaagcagaaaaactgttccggatccgggaggcggaagaaacaaaaaaaagcctgatgcaggtagccagtgagcatattgcgccgcttcaggatgctgcagatctggaaattgcaacgaaggaagaaacctcgttgctggaagcctggaagaagtatcgggtgttgctgaaccgtgttgatacatcaactgcacctgatattgagtggcctgctgtccctgttatggagtaa

SEQ ID NO: 182 - DNA, 2376 bp, Artificial Sequence
  Synthetic: >SIED6
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagctgatcctgcttctgtccctccgcttcctgatatctggctacccttgaatgattctctggaagcgataacagggtatgcgccggggtataaaacaataaccatcggcagcgatgaaatcactgtgccagttaatggcatatgccaatttagccgggcttcatctgcaacgtatattgataagtccgggcatattaccgtggcagggaataacgttcctcgttttgaaaaatatggtttgctgatagagaatcagcgaacaaacatgttcgtaaatagttttaatcctgatgcgtggaataaaagcggtggtatatctgtaacatcatcaacagatgaatttgagtttaaatatggacgtttcacagtaggaagcgacatagcaggaacgacaacagggagaaatatatgcacagttgctggtaatagaggcatagatgtgactggcgatgatcagtacagtaaaggtccgtatgttaccgcgtcgttcagggtaagaagtgatctcaatgttcgcgcacgtatccgttttgaacggtataactcggaaggatacactttcctttgtgacgcctatttgtcattacagacccatgaactacaaattacgggtgataatgcccagctattaacagcaaactttgaaatcgatccaggtagtggatggatatattttcaggcaaccctgaaatgtctgccagaatggggaatggttggtacgcagttgcaaattgcagccgacagagctgtggggtcttttgcaacaggtgactggatagaagtaaccaccccgcaatttgagtatggtgcttgtgcaacttcctttatcataacgacaacagagccagcgactcgtgcatcagatttatgtaaatttccgctgatgaaaaatatgtataccatgccttttacgttcatggtggaagtccataaaaactggtttattgctcataatgctgcaccgcgagtaattgatacagaaaaccatcagtcaggtgctccatttatcatgggatttggctcttctggaactatcagtcaggacggttatccctattgtgatataggcggggctaaccgacgtgtatatgagtcatgcggagtaagagatcttgttatgggattcagggttaaggctgacggcatgacatgctcatttgcaaataagcatataagcacagaaacaaaaacagtatggaaatatattcgtgaagctgctgtgattcgtatcgggggacaaacgacgacaggattacgacaccttaatggtcatataaaaaacctccgtttctggaacagagcattgtcagatacgcagcttaaggaatacgtataa

SEQ ID NO: 183 - DNA, 270 bp, Artificial Sequence
  Synthetic: >SIED6 accessory protein 1
atgcgggatataacattacgattcgataacagagaacagtttaacgcaattgtatatgacagtggcctgttcagtcttgaagaagaaaacgggattcttgttgatgttattggccgcgttatcgattacgaggagccagaaaacgaaagatgtacaggcattgatcgcggcggttttttcgtaaacatgaggattgttgatagcagtaaaaacatatcttctttaatgcctttcattacgacagatcagcatgtaaggacatgggcttaa

SEQ ID NO: 184 - DNA, 885 bp, Artificial Sequence
  Synthetic: >SIED6 accessory protein 2
atggttacaaaaacagtaattcctgatgacatcaaaacgctaaaatccgatgttagtaaactaaaaaacgatcaaggaagctacgcaacaaaatcatatgtagacagcaaagatgaaaccgttggtgactggtctgcttcatggtatcagcaggtattgccaactagcggagctatatttgggagaaaactccgctcaactcaccggacggcaggtgttgaggatgcgtattgcgaactataccttaaaaaatggatagacagcccagggaacgcaatggcgcgccttaacctgaacgataacggtgaaaatatttgctgggattttaccaacctttacggcggaacaatgatcttccctggaacttcaggctatctgaaaatggggaactgtctcatgtcgtatggtgtgcggggaagtaacgcgcttattaagtttgataatacagactcattgcagatcaaatatgctaatcacgggtcgaccatgacactaaacacgcaaggcacggcgtattctggtgtgtcgacgttattatggggaaattccagtcgtccagttgtttatgagattagggatgatggcgggctttttttgttttatgcacaaaggaacccagataaaacctatcagcttgagataaacgggccatgtaaggctacatcattcgaccaggtgtcggacagagatcttaaagaaaacattcgggttattgataatgccactgaacgcatcagattaatgaatgggtatacttaccgtctcaagtctaatggtatgccttatgctggcgttattgcgcaagaggcacttaatgcaatccctgaatcagttggtagcacaataaagtacaagagcggggacaatgggtctgatggagaatag

SEQ ID NO: 185 - DNA, 3291 bp, Artificial Sequence
  Synthetic: SIEA11
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcaaatgacaacgcaaattcacgtctggcgaaaaatcagaatggtgcagatatccaggataaatcagcttttctggacaatgttggcgttaccagcctgacgtttatgaaaaacaatggcgaaatgccggttgatgctgatctgaatacgtttggttctgttaaggcttattcaggtatctggtctaaagcaacgtccaccaacgcaacactggagaaaaacttccctgaagataatgctgtcggtgtgcttgaggtttttactggcggcaattttgcaggcacgcaacgctataccacacgtgacggaaatttgtatatccgcaaactcattggaacatggaatggtaatgatggaccatggggagcatggcgccatgttcaggctgtaacgcgagctctaagtacgaccattgaccttaactctctcggtggcgcagaacatttaggtctatggagaaacagcagttcagcaatagcttcttttgaacgacattaccccgagcagggaggagacgcgcagggcattctggaaattttcgaaggtgggctatatggacgcacacagcgttatacaacccgtaacgggactatgtatattcgcggcctgacagccaaatgggatgcagaaaatccacagtgggaagactggaaccaaattggttatcagaccagtagtaccttctatgaggatgacctggatgatttgatgtctccaggtatttacagtgtgacaggcaaagcgacccacaccccaatccaggggcagtctggttttctggaagtcatcaggcgcaaggatggtgtctatgttttgcaacgttacacgaccacaggaaccagcgcagctacaaaagaccgtttatatgagcgagtgtttcttggtggctcatttaacgcgtggggggagtggcgacagatttataactcaaactctttgccgttagagttgggtatcggtggcgcagtggcaaaactcaccagcctggactggcagacatacgattttgtgccgggcagtctgataaccgttcggctggataacatgaccaatattcccgacggtatggactggggcgtcattgatggcaacctgataaacatctcagtcggtccgagtgatgattctggttcgggacgctcaatgcatgtatggcgcagcactgtaagtaaagccaactaccgcttttttatggtgcgtatttcaggaaatccgggaagccgcacgatcacgacaagacgtgtgccaattatcgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactattggtggggcatcaacgttaattcttcattttaatatcggggaaggaagttgtcccgccgcccagtttcgcgttaattataagaacggtggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatgttatgcgctttgtctccggaagcgttcaaagtaataaaaccataaatattacggggcgtgttaatccctcggattacggtaactttgattcccgctatgtgagagatgtcagacttggcacacgtgttgtccagaccatgcagaaaggggtgatgtatgagaaagcagggcacgtaattaccgggcttggtattgtcggtgaagtcgatggtgatgaccccgcagtattcagaccaatacaaaaatacatcaatggcacatggtataacgtcgcacaggtgtaa

SEQ ID NO: 186 - DNA, 528 bp, Artificial Sequence; identical to SEQ ID NO: 92
  Synthetic: SIEA11 accessory protein 1

SEQ ID NO: 187 - DNA, 2238 bp, Artificial Sequence
  Synthetic: EB6
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaagattgcgatggataatgccaatgcccgtctggcaaaagaccggaacggagcagatattcccaataagccgctgtttatccaaaacctcggtttacaggaaacggtaaacaaggctggtaacgccgttcaaaagacaggcgataccttgtccggcggacttacttttgaaaacgactcaatccttgcctggattcggaatactgactgggcaaagattggatttaaaaatgatgccgacagcgacactgattcatacatgtggtttgaaacaggcgacaacggcaatgaatatttcaaatggagaagccgccagagcaccacaacaaaagacctgatgaatcttaaatgggatgctttgtatgttcttgtcaatgccattgtaaatggcgaagtcatatcaaaatcagcaaacggcctacgtattgcttatggtaattacggattctttattcgtaatgatggttcaaatacatacttcatgttgacaaactccggtgacaacatggggacttataacggattaaggccattatggattaataacgctactggcgctgtttcgatggggcgtggtcttaatgtttcaggggagacactttcagaccgttttgctattaacagcagtaatggtatgtggattcagatgcgcgataacaacgctatctttgggaaaaatatagttaacactgatagcgctcaggcgttacttcgccagaatcacgccgaccgaaagttcatgataggtggactggggaacaagcaatttggcatctacatgattaataactcaaggacagccaatggcaccgatggtcaggcgtacatggataataacggtaactggctttgtggtgcgcaagttattcccggcaattatggcaattttgactcacgctatgtgagagatgtccgacttggcacacgtgttgttcaattgatggcgcgtggtggtcgttatgaaaaagccggacacgcaattaccggattaagaatcattggtgaagtagatggcgatgatgaagccatcttcaggccaatacaaaaatacatcaatggcacatggtataacgtcgcacaggtgtaa

SEQ ID NO: 188 - DNA, 528 bp, Artificial Sequence
  Synthetic: EB6 accessory protein 1
atgcagcatttaaaaaatattaagtctggaaatcctaaaacgaaagaacaatatcagctaacaaagaattttgatgttatctggttatggtccgaagacggtaaaaactggtatgaagaagtaaataactttcaggacgacaccataaagattgtatacgacgaaaataatattattgttgccataaccaaagatgcctcaacgcttaatcccgaaggctttagcgtcgttgagattccagatataacagccaatcgtcgtgccgatgattcagggaagtggatgtttaaggacggagctgtggttaaacggatttatacggcagacgagcaacaacaacaggccgaatcacaaaaggccgcgttactttccgaagcagaaaacgttattcagccactggaacgcgctgtcagactgaatatggcgacggatgaggaacgcgcacgactggagtcatgggaacgctacagtgttctggtcagccgtgtggatacggcaaagccagaatggccacaaaagcctgaataa

SEQ ID NO: 189 - DNA, 3321 bp, Artificial Sequence
  Synthetic: AH11L
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcaaatgacaacgcaaattcacgtctggcgaaaaatcagaacggtgcagatatccaggataaatcagtttttctggacaatgttggcgttaccagcctgacgtttatgaaaaacaatggcgaaatgccgcttgatgctgatctgaatacatttggtcccgttaaggcttatctggggatctggtctaaagctacctcaactaacgcaacactggagaaaaatttcccggaagataatgctgtcggtgtgcttgaggtttttgctgccggcaattttgcaggtacgcaacgctttaccacaagagacggcaatgtatacatgcgtaaactcgccaataagtggaatggcactgatggtccgtggggcgtatggcgtcacactcaatcagctacccgccctttgagtacgactatagacctgaatacgcttggagccgccgaacatcttggtttatggcgtaacagtagctcggctatagcttcatatgaacgcaattatccagaggaaggcggctttgctcaggggacgcttgagatcctcgaaggcgggaattatggaagaacgcaacgttataccactcgccgtggaaatatgtatgtccgctgccttgcggcaagctgggatgcatcaaatccgcagtgggaaccgtggttaagagtcggtcatcagtcagagagtcgttattacgaaggtgatttgaatgatgtaacctcaccaggtatttacagcgttacaggtaaagcgaccaacggtccagtactggacggaaacggcgtgactgtactcggcattctggaagtgttgaggcggtttgatggtgttaatgtatggcagcgttatacaactgccggaacaggtacaacccttaaaggccgcacctttgagcgcgtctttaccggcagctcatggagcgaatggcgggaagtctacacctcgtattcacttcccctgaatctgggtatcggcggtgctgtggcaaagctcaccagcctggactggcagacctacgattttgtgccgggcagtctgataaccgttaggctggataatatgaccaatattcccgacggtatggactggggcgtcattgatggcaacctgataaacatcgcagttggtccgagtgatgattccggtacggggcgctcaatgcatgtatggcgcagcactgtaagtaaagcgaactaccgattttttatggtgcgtatttcaggaaatccgggaagccgcacgatcacagcaagacgagtaccaatcattgacgaagcccagacatggggcgcgaaacagacattcagtgctggcctttctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttgggtggaactggagtagcggagcctataacgcaactactggtggggcatcaacgttaattcttcattttaatatcggtgaaggaagttgtcccgccgcccagttccgcgttaattataagaacggcggtattttttatcgttctgctcgtgacggttacggattcgaggctgactggtctgagttttataccacaacgcgaaaacctacagcgggagatgtcggtgcactgccgttatctggtggtcaattgaatggtgctctgggtataggaacatccagtgctcttggcggtaattcgattgttttgggtgataatgacacgggctttaaacaaaatggtgatggtaatctggatgtttatgctaatagcgtccatattatgcgctttgtctcgggaagtattcaaagtaataaaaccataaatattacggggcgtgttaatccctcggattacggtaactttgattcccgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggtgtatattacaggccggttcagaaatacattaacgggacatggtataacgtggcgcaggtataa

SEQ ID NO: 190 - DNA, 528 bp, Artificial Sequence
  Synthetic: AH11L accessory protein 1
atgcagcatttgaaaaatattacggcgggtaatccaaaaacggttgaacaatatcaattgacaaagggttttgatgttgtctggtttttttcagaagatggtaagaactggtacgaagaacaaaagtattttgctgatgacacgataaaaatagcgtacgacaaagataatattatccgctatgtggaaaaggatgtgacagctatcagaccggatggattaagtgttgttgaagtggcggatattactgctaaccgacgggcggacatttcagggggctggatgtttaaggacggcaaagtgattaaacgcatttatacggcagaggaattgctgcagcaggcagaaaaccggaaagccagacttcttgcagatgctgaatccgtgattttgccgctggagcgcgcggtcagactgaacatggcaacagatgaggagcgtagccgactggatgcatgggagcgttacagcgttctggtcagtcgtgtggatcctgcaaatcctgaatggccggaaatgccgcaataa

SEQ ID NO: 191 - DNA, 786 bp, Artificial Sequence
  Synthetic: WW55 3.0 accessory protein 1
atggcaatatcttctggatgggtaggatcatctgctgtgtccgagactggtcaacggtggatgagcgccgcaatgcaagctgttcgcttaggtcgtccggcgtatatgtcggcaatggtcggacgctctaaagagattcattatagcattggtgctagtaactcttacaataaagacactcttattaactggatgaaagcacaaggatctactccggtagtaattactatcacgggtaatattgtttcccaatctactggcgttccttgtcttgatttccctagctcactgacaaacgaatatgtaacactcattattaactctggtgttcatgtattaggtcgtggaggaaatggcggaagtaactctgctggtggagcaggaggaaatgcaataaataacggaattggaactcgtttaagaataaacaataatggtattattggtggtggcggtggtggcggtgctggtgctagatacaatcctttccctcaaatggatatgaaatttggcggcggtggaggccgtccatttggtgctgcgggtgcggcaggaggcggcgcagcggcagcatctgctggtacaatttctgccccaggtaaaggcactgtttctggggttcattatggaggagatggtggagatttgggagctgctggcaaatcttcatatattaaaggtggtactggtggaactgttcactcgggtggtgctgcgggtaaagctgttactggtaatgcccctcgctgggataaagtaggcacgatctacggtgctcgcgtgtaa

SEQ ID NO: 192 - DNA, 261 bp, Artificial Sequence; identical to SEQ ID NO: 165
  Synthetic: WW55 3.0 accessory protein 2

SEQ ID NO: 193 - DNA, 2394 bp, Artificial Sequence
  Synthetic: STF68B
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcatctgccaacagtcaaaaagctgcaaagacgagcgaaaccaacgcaaagacaagcgagactgcggcggctaactcggcgaaagcatcagctgcaagccagacggctgcaaaagcgagtgaagacgcagccagagagtatgcaagccaggctgcggagccgtataaacaagttttgcagccgcttcccgatgtgtggataccgtttaacgattcactggaaatgattactggtttcgctcctggttataaaaaagtaactatcggtgatgatgttattacttttccatcagagaaggttgtatctttcactcgctccacttctgcaacgtatataaacaaatcaggttcatttgcttttgcagaaattaacgagccgcgctttgaaaaggaaggtttattaattgaaggtcagaggacaaatacatttactaatagtaacaatccttcattatggaattatgacgacaagaatatagaaataaccacatcggttgatgaatatggttttaaatatggtttgttcgatgtaaaggaaacatcaactactgaaagggcgacgataatatctactggatacagtagggttattgatgttgctgcaaatgaatctgttactttgtcctgtagggttaagaagataaatggagaaggtattataacgttaagacccagaatatctttcgttaacgatgacggtacaagcaacacgctggtagctggttcctacatagattgcgaaactggtgatgttttaggtttttctggtggggatgctgtaaatcatgtcatatacagagaagctaacggatggttacgcgtcgaatttacatataaatcaccagaagcaaaaagcatgtatgggcgctttgaaatgggagcagataaaagggcgatcaaaaaaggcgatcagataatgtttactacgccgcaatttgaaaaaggatcgtgtgcatcatcatttatcgttacatcagatgtggcagttacacgggctagtgacgtggtaataatgccaataagactgaactggtcaacacctccgttaagcgttcttatggaagttaatatcaactgggacaaaatgccaaacagtgaaggttcagcaaggcttcttaacgtgtcaataactggcgcaacaacggatgttgctgatgaaagttatatgtattttggttttacctctggaggcgcgcgctcaattataactaacggaaaaggaacaaagaccgagtataaagcctactgtaacaggacaacccgcaggtttattgctgggtttaagtttacagagcagaaagaattgcgtgctgttataaacggtaactttggcgctgttgatgtatcacaacacacaagacaacgttatacagaagggccaataaatataggcggtcaatcaatatcaggtaacaggcatttatttggacacgtgcgcaatttacgtatctggcataaggaactgacagatgcacaaatgggagaaagaatataa

SEQ ID NO: 194 - DNA, 282 bp, Artificial Sequence
  Synthetic: STF68B accessory protein 1
atgcgagacttaaccctcaaattcataaacaaggccgacttttcggcctttatggatagcattggttatgaagatgacgaggtaatgcagaacaatgttctcattgatgtgataggtaacgtgtacaaagaaaccggagaacttactgaagatggcgagccggtatgtgttaaggaagacggatattttgtaaacgtgcgcatcattaatgatgcaaaaaaatcgtcaatattcgataaatacgcggttgttgttgagcatcaacttcgtggctggatgtga

SEQ ID NO: 195 - DNA, 1041 bp, Artificial Sequence
  Synthetic: STF68B accessory protein 2
atggctacatcgacagtaattcctgatgacatcaaaacgctaaaatccgacgttagcaaattaaaaaacgatcaaggaagctacgcaacaaaatcatatgtagacagcaaagatgaaaccgttggtgactggtctgcttcatggtatcagcaagtattgccaactagcggagctatatttgggagaaaactccgctcaactcacaggacggcaggtgttgaggatgcgtattgcgaactatacctcaaaaaatggatagacagtccaggtaacgcaatggcgcgccttaacctgaacgataacgggacaaacatttgctgggactttaccaacctttatggcggtacgatgatttttcccggtgacagcggatacctcaaaatgggtaactgccttatgtcatacagcaagcgtggaagtaacgcgcttattaaatttgattacaccgacacattacagatcaaatatgctaatcatgggtcaaccatgacattaaacacacagggaaccgctcacgctggcgtaacaactagactatggggtaattctagccgtccggttgtttatgaagttggcgtagatgaggctctgtatatgttctacgcacagaaaactaccagcaatacctacgaattaacggttaacggcgcgtgcaatgcaagtgcatttaatcaaggctctgaccgggatctgaaagacaatattcaggtgatcgataatgcaaccgaccgcattcgtaaaatgaacggctatacatacacgcttaaagaaaacggtatgccttacgctggtgttattgcacaagaaaccctggaagccatccccgaagccgtaggggctatgatgaaatatccagacggcgggagtggattagatggagaagaaggtgaacggtattacactgtagattattctggtgttactggcttgcttgttcaggtagccagagagtcagacgacaggataacagcactggaagaagaaaacgcagaattaagacaaagattatctgcaattgaggcggcgcttgcgtctaaataa

SEQ ID NO: 196 - DNA, 2640 bp, Artificial Sequence
  Synthetic: >STF90B
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatataccgcacaggacgccaccaccgcgcgaaaaggccttgtccagctaagtagcgtcaccaacagcgattctgaaacgcttgcggcaacgccaaaggcggttaagacagcgtatgaccttgctaacgggaaatacactgcacaggatgccaccacagcgcgaaaaggtcttgtccagctcagtagcgccaccaacagcgattctgaaacgcttgcggcaacaccaaaagcggtgaagtctgcctatgacaatgctgaaaaacgtcttcagaaagatcagaacggtgcggatattccgggaaaggatactttcacgaaaaatatcggtgcctgtcgtgcttatagcggtgctttgagcactgacgccggaaactggacaaccgctcagtttattgactggctagagtctcagggagcctttaatcatccctactggatgtgcaagtgttcctggtcatacggtaataacaaaattattaccgatactgactgtgggactattcatcttgcaggttgcgtgattgaggttatgggcgttaaagctgcaatgaccattcgtgtgaccactccgagtacatcaagcggtggtggtaccaccagtgcgcaattcacgtatatcaatcacggagctgattatgcgccgggctggcgacgcgactacaatacgaaaaataagcaaccggcttttgcattagggaaaacaggaaatacggttgcaaataataaagcggtaggatggaactgggacagtggtgcttattgtgcacaggatggcggagcatcaaaaatggtgctgcatttttacacgggtgagggaagttgtccggcaatgcagtttcttgtggattataaaaacagggggattttttacaggtcggcacgtgatgggtatggatttgaggctgactggtcagagttttataccacatcacgaaagccaacacctgcggatattcttgctctggcattatcaggcggaagcatgtcaggcagcataaaatttatcaatgatgccttcctgatttgggaaagaaacactgactgggcgaaaattggatttaaaaatgattcagatgctgattctgactcatacatgtggtttgaaactggtgataatggcaatgaatattttaaatggcgcatcaggtctggcagcacaacaaaagacctgatgacgcttaagtctgatgcactacgggttaccgggcaggtgataccatcaaatttcagcaattttgactcccgctatgtccgggatatccggcttggtggtgccgccacatacaaacctgcgaacaatggcatgacatggacacatcaggcaccgtccgggtgtgtatataccggcattattgttcaggataccggctcaaactctgccgataacattggtggcgtatattacagaccggtgcagaaatacattaacgggacatggtataacgtggcgcaggtataa

SEQ ID NO: 197 - DNA, 528 bp, Artificial Sequence
  Synthetic: STF90B accessory protein
atgcagcatttaaaaaatattacggcgggtaatccaaaaacggttgaacaatatcaattgacaaaggactttgatgttgtctggtttttttcagaagatggtaagaactggtacgaagaacaaaagtattttgctgatgacacgataaaaatagcgtacgacaaagataatatcatccgctatgtggaaaaggatgtgacagctatcagaccggatggattaagtgttgttgaagtggcggatattactgctaaccgacgggcggatatttcagggaactggatgtttaaggatggcacagtgatcaaacgaatttatacggcagaggaattgcaacagcaggcagaaaacaggaaagccagacttcttgcagatgctgaatccgtgattttgccgctggagcgcgctgtcaggctgaatatggcaacagaggaggagcgtagcagactggaaagatgggaacgctacagcgttctggtcagtcgtgtggatcctgcaaatcccgaatggccggaaatgccgcaataa

SEQ ID NO: 198 - DNA, 2616 bp, Artificial Sequence
  Synthetic: STF117
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatatactgcgcaggatgccaccacagcgcgaaaagggcttgtccagctcagtagcgccaccaacagtgattctgaaaccctcgcggcaacgccaaaagcagtgaagtctgcctatgacaatgctgaaaaacgtcttcagaaagatcagaacggtgcggatattccgggaaaggataccttcacgaaaaatatcggtgcctgtcgtgcttatagcggcgctttgagcactgaagccggaaactggacaaccgctcagtttattgaatggctggattcccgtggtgcatttaatcatccgtactggatgtgcaaaggctcctggtcatatgcaaataacaaaatcattacggataccggatgtggtgatatccacctggctggttgtgtcgtcgaggtcatgggaactaaatctgcaatcactatccgagtgaccacgccgacaacatcaagcggtggcggtacaaccagcgcgcaattcacttacattaatcatggggacggctactcccccggctggcgtcgtgactggaatcgtcagggcgacgcaatgaccggaacgattaatcaggatggcggaagccagaatgcctatatgtctacggccttatgttcaggcaccagaggcggcaaaaaatatctcagaaagtttcgtggtggagaaggagacactatctggcatgaaacagtacagggcggggtagttcgctgggcgactggtaatactgatgctcaggaagaattatcactcagctccgcttatggtctccgttcaagaggtgagattacatcaagcagtgctaatggtctgcgcattgcttatggcaattatggattctttatcaggaatgatggcagcagcacttattttatgttgactaaatcaggtgacagattaggcacttataataatttaagaccactgattataaatgatgccacgggtgctgtatcaatggggcatggcctgagtgttactggtgatattgcctcaagtaccaaagtacgtgccggtagcgggaaaaaattcacggtcagcagcagtaatacatccacgaaggaagccgcattcaatttgtggggaaactcaagtcgtccggtggtggctgaattaggtgatgatgcaggctggcatttttacagtcagagaaatacagataacagcatcacttttgctgttaacgggcaggtatcaccatctaactatagtaattttgattcacgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggcgtatattacagaccggtgcagaaatacattaacgggacatggtataacgtggcacaggtataa

SEQ ID NO: 199 - DNA, 528 bp, Artificial Sequence
  Synthetic: STF117 accessory protein 1
atgcagcatttgataaatataaccgcgggtaatccaaaaacggttgaacaatatcaattgacaaaggactttgatgttgtctggttttttacagaagatggtaagaactggtacgaagaacaaaagtattttgctgatgacacgataaaaatagcgtacgacaaggataatattatccgctatgtggaaaaagatgtgacagctatcagaccagatggattaagtgtggttgaagtggcggatattactgctaaccgacgggcggacatttcagggaactggatgtttaaggacggcaaagtgattaaacgcatttatacggcagaggaattgcagcagcaggcagaaaaccggaaagccagacttcttgcagatgctgaatccgtgattttgccactggagcgcgctgtcaggctgaacatggcaacagatgaggagcgtagccgactggaagcatgggaacgctacagtgttctggtcagccgtgtggatcctgcaaatcctgaatggccggaaatgccgcaataa

SEQ ID NO: 200 - DNA, 2517 bp, Artificial Sequence
  Synthetic: O111
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcggcatcaggtgcattacagaagaatcaaaacggtgcagacattccgggcaaagatacctttaccaagaatatcggtgcttgtcgtgcttattcggcatggcttaatatcggaggtgattctcaggtatggactacggctcagtttatctcttggctcgagagtcagggtgcgtttaatcatccgtactggatgtgcaaaggctcttgggcgtacgcgaacaacaaagtcatcaccgacactggttgtggtaacatctgtctggcgggtgcagtagtggaagttatcggtacgcgcggtgcgatgacgatccgtgtaactactccatctacctcctccggtggcggtatcaccaacgcccagttcacttacattaaccacggcgatgcctatgctccgggctggcgccgtgattacaacactaaaaaccaacaacctgcgtttgcactgggtcagacgggtagtcgtgtggcgaacgataaagcggtcggttggaattggaactctggtgtgtacaacgctgatattagtggagcttctactctgatccttcattttaacatgaatgctggaagttgtccggcagtgcagtttcgtgttaactatcgtaatggaggaatcttttaccgctctgcacgtgacggctacggcttcgaagcgaactggagtgaattttacacgaccactcgtaagccgagtgctggagatgtgggagcttatactcaggcagaatgcaattcgcgtttcattactggtattcgtctgggaggtttaagttccgtgcagacttggaacggtccaggttggagtgatcgtagtggctatgttgtgacaggcagtgttaacggcaaccgtgacgaactgatcgacactactcaagcgcgtccgatccagtactgcattaacggaacttggtataacgcgggaagtatctaa

SEQ ID NO: 201 - DNA, 534 bp, Artificial Sequence; identical to SEQ ID NO: 94
  Synthetic: O111 accessory protein

SEQ ID NO: 202 - DNA, 2505 bp, Artificial Sequence
  Synthetic: DC1
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggcagcatatgaccttgctaacgggaaatacactgcacaggacgccaccacagcgcgaaaaggtcttgtccagctcagtagcgtcaccaacagtgattctgaaaccctcgcggcaacgccaaaagcagtgaagtctgcctatgacaatgctgaaaaacgtcttcagaaagatcagaacggtgcggatattccgggaaaggataccttcacgaaaaatatcggtgcctgtcgtgcttatagcggcgctttgagcactgaagccggaaactggacaaccgcgcagtttattgactggctagagtctcagggagcctttaatcatccctactggatgtgcaagtgttcctggtcatacggtaataacaaaattattaccgatactgactgtgggacgattcatcttgcaggttgcgtgattgaggttatgggtgttaaagcagcaatgaccattcgtgtgaccactccgagtacatcaagcagtggtggtaccaccagtgcgcaattcacgtatatcaatcacggagctgattatgcgccgggctggcgacgcgactacaatacgaaaaataagcaaccggcttttgcattagggaaaacaggaaatacggttgcaaataataaagcagtaggatggaactgggacagtggtgcttattgtgcacaggatggcggagcatcaaaaatggtgctgcatttttacacgggtgagggaagttgtccggcaatgcagtttcttgtggattataaaaacagggggattttttacaggtcggcacgtgatgggtatggatttgaggctgactggtcagagttttataccacatcacgaaagccaacacctgcggatattcttgctctggcattatcaggcggaagcatgtcaggcagcataaaatttatcaatgatgccttcctgatttgggaaagaaacactgactgggcgaaaattggatttaaaaatgattcagatgctgattctgactcatacatgtggtttgaaactggtgataatggcaatgaatattttaaatggcgcatcaggtctggcagcacaacaaaagacctgatgacgcttaagtctgatgcactacgggttaccgggcaggtgataccatcaaatttcagcaattttgactcccgctatgtccgggatatccggcttggtggtgccgccacatacaaacctgcgaacaatggcatgacatggacacatcaggcaccgtccgggtgtgtatataccggcattattgttcaggataccggctcaaactctgccgataacattggtggcgtatattacagaccggttcagaaatacattaacgggacgtggtacaacgtggcgcaggta

SEQ ID NO: 203 - DNA, 528 bp, Artificial Sequence
  Synthetic: DC1 accessory protein 1
atgcagcatttgataaatataacggcaggtaatccaaaaacggttgaacaatatcaattgacaaaggactttgatgttgtctggtttttttcagaagatggtaagaactggtacgaagaacaaaagtattttgctgatgacacgataaaaatagcgtacgacaaagataatattatccgctatgtggaaaaggatgtgacagctatcagaccagatggattaagtgttgttgaagtgccggatattactgctaatcgacgggcggacatttcagggggctggatgtttaaggacggcaaagtgattaaacgcatttatacggcagaggaattgcagcagcaggcagaaaaccggaaagccagacttcttgcagatgctgaatccgtgattttgccgctggagcgcgcggtcagactgaacatggcaacagatgaggagcgtagccgactggatgcatgggagcgttacagcgttctggtcagtcgtgtggatcctgcaaatcctgaatggccggaaatgccgcaataa

SEQ ID NO: 204 - DNA, 2748 bp, Artificial Sequence
  Synthetic: STF94A
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaatataccgcacaggacgccaccacagcgcgaaaaggccttgttcagctgagtagcgccatcaacagcgattctgaaacgcttgcggcaacgccaaaggcggttaagacagcgtatgaccttgctaacaggaaatacactgcacaggatgccaccacagcgcgaaaaggtcttgtccagctaagtagcgccaccaacagtgattctgaaacgctggccgcaacatcaaaagcggtgaagtctgcctatgacaatgctgaaaaacgtcttcagaaagatcagaatggtgcggatattccgggaaaggataccttcacgaaaaatatcggtgcctgtcgtgcttatagcggcgctttgagcactgaagccggaaactggacaaccgctcagtttattgaatggctggattcccgtggtgcatttaatcatccgtactggatgtgcaaaggctcctggtcatatgcaaataacaaaatcattacggataccggatgtggtgatatccacctggctggttgtgtcgtcgaggtcatgggaactaaatctgcaatcactatccgagtgaccacaccgacaacatcaagcggtggcggtacaaccagcgcacaattcacttacattaatcatggggacggctactcccccggctggcgtcgtgactggaatcgtcagggcgacgcaatgaccggaacgattaatcaggacggtggaagccagaatgcctatatgtctacggccttatgttcaggcacaagaggcggcaaaaaatatctcagaaagtttcgtggtggagaaggagacactatctggcatgaaacagtacagggcggggtagttcgttgggcgactggtaatactgatgctcaggaagaattatcactcagctccgcttatggtctccgttcaagaggtgagattacatcactcagtgctaatggtctgcgcattgcttatggcaattatggtttctttatcaggaatgatggcagcagcacttattttatgttgactaaatcaggtgacagattaggaacttataataatttaagaccgctgattataaatgatgccactggtgctgtatcaatggggcatggcctgaatgttactggtgatattgtctcaagtaccaaagtacgtgccggtagcgggaaaaaattcacggtcagcagcagtaatacatccacgaaggaagccgcattcaatttgtggggaaactcaagtcgtccggtggtggctgaattaggtgatgatgcaggctggcatttttacagtcagagaaatacagataacagcatcacttttgctgttaacgggcaggtatcaccatctaactatggcaactttgattcacgctatgtccgggatatccggcttggtggtgctgccacatacaaacctgcgaacaatggcatgacatggacacatcaggcaccgtccgggtgtgtatattccggcattattgttcaggataccggctcaaactctgccgataacattggtggcatatattacagaccggtgcagaaatacattaacgggacatggtataacgtagcgcaggtataa

SEQ ID NO: 205 - DNA, 528 bp, Artificial Sequence
  Synthetic: >STF94A accessory protein
atgcagcatttgataaatataatggcgggtaatccaaaaacagttgaacaatatcaattgacaaagggctttgatgttgtctggttttttacagaagatggtaagaactggtacgaagaacaaaagtattttgctgatgacacgataaaaatagcgtacgacaaagataatatcatccgctatgtggaaaaggatgtgacagctatcagaccggatggattaagtgtggttgaagtggcggatattactgctaaccgacgggcggatatttcagggggctggatgtttaaggacggcaaagtgattaaacgcatttatacggcggaggaattacagcagcaggcagaaattcggaaagccagacttcttgcagatgctgaatccgtgattttgccgctggagcgcgcggtcagactgaacatggcaacagaggaggagcgcacacggctggaggcttgggaacgctacagcgttctggtcagtcgtgtggatcctgcaaatcctgaatggccggaaatgccgcaataa

SEQ ID NO: 206 - DNA, 1509 bp, Artificial Sequence
  Synthetic: STF69A
gcttctgccactgcatcagctaacagtcaaaaagcagcaaaaaccagtgaaaccaacgcaaaggcgagcgaaacagcggctgcgaactcagcgaaagcatcggcagcaagccagacggcagctaaagcaagcgaagatgcagccagagagtacgcaagccaggctgcggagccgtataaatatgtcttacagccgttacctgaggtgtggataccgtttaacgattcactggatatgattaccgggtttgctcctggatataagagcatcacagttggtgacgatgttattgcattgccgtctgaaaaggttgtttcatttaccagggcgtcaactgcaacgtatatagataagtctgggtgttttgctgaatcagcgataaatgaaccacgttttgaaaaagatggtctgctcattgaaggtcagagaacgaatactttttcttatacgaatacaccagtatcgtggaactatgacactgctaacttaactattaccacgggagttgatgagtatggtttcagttatggtttgtttggcgttaaagaaacatccacaactgaaagggcgacattaatttctactggatataccagggttatttcagtttcggcaaatgaatcagttactttatcctgcagagttaaaaaagtaagtggggatggtattatcacgttgcgtccaagaatatcatatgttaacgacgatggctcaagtaacacactgaccgctggcgcatatattgattgcgagactggcgatatgttgagttattctggaggtgaggcggcaacttataacatattcagagagtctaatggatggattcgtgttgagtttacctacaaatcaccagaagcaaaaaatatgtatgggcgttttgagtttggagcacatcaacgatcaatcaagtctggcgataaattaatgttaacaacccctcaattcgaaaagggactaaacgcgtcatcttttatcatcacaacagaggtcggtgccacgagagcaagtgaccaggtaatcatacctatacctttcaattgggcaactccaccagttagtgttctcatggaagttaatgttaattgggattctgaaatgcctaatttagaaggctctgcgcgtttgcttaatatctcaattacaggggcgacgactgaagtttctgatgaaagttatatgtattttggttttaccactcgtggtaaaaggctaattatcaccaatggcaaaggaacaaaaacagaatataaagcatatgggaatagagagaaaaggaaatttgttactggctttaagtttacagaagataaacagttgcaggttgttgttgatggaattttaggtggcagctccccgtctctgcatacattgcaacgttatactgccggtaatattaatatcggtggacaatcatccagtggcaacagacacctgttcggtcatgtgaaaaatttacgcatttggcataaagaattaactgaggcacaaatgggggagtcaatctaa

SEQ ID NO: 207 - DNA, 282 bp, Artificial Sequence
  Synthetic: >STF69A accessory protein 1
atgaaagatttaacactcaaatttgaagacagggccgacttttcggcctttatggagagtattggctattatgatgacgagtcgatgcaggatgatattcttatcgacgtgataggtaacgtgtacaaagaaaccggagaactgactgaagatggcgaaccggtatgtgttaaggaagacggatattttgtaaacgtgcgcatcattaatgattcgcaaatatcgtcattattcgatgaatacgtggttgctgttgagcatcaacttcgtggctggatgtga

SEQ ID NO: 208 - DNA, 1041 bp, Artificial Sequence
  Synthetic: >STF69A accessory protein 2
atggctacatcgacagtaattcctgatgacatcaaaacgctaaaatccgacgttagcaaattaaaaaacgatcaaggaagctacgcaacaaaattatatgtagacagcaaagatgaaatcgttggtgactggtctgcttcatggtatcagcaggtattgccaactagcggagctatatttgggagaaaactccgctcaactcacaggacggcaggtgttgaggatgcgtattgcgaactatacctcaaaaaatggatagacagtccaggtaacgcaatggcgcgccttaacctgaacgataacgggacaaacatttgctgggactttaccaacctttatggcggtacgatgatttttcccggtgacagcggatacctcaaaatgggtaactgccttatgtcatacagcaagcgtggaagtaacgcgcttattaaatttgattacaccgacacattacagatcaaatatgccaatcatgggtcaaccatgacattaaacacacagggaaccgcttatgctggtgttactgctcaattgtggggcaactccagccgtcctgttgtttatgaagtcggtgttgatggtggcgcttatatgttctatgcgcagaaaaataccgataacacctatatgttaagcgttaatggtgcatgtcatgccaccgcatttaaccagcattccgaccgggatctgaaagacaacattcaggtgatcgataatgcaaccgaccgcatccgtaaaatgaacggctatacatacacgcttaaagaaaacggtatgccctatgctggtgtcattgcacaggaagctctggaagcaatcccagaagttgtaggttccgcaatgaaatatcaggacggtgcgagcggatcggaaggtgaagaaggtgaacgttattacacagtagattattctggtgttactggcttgcttgttcaggtagccagagagtcagacgacagaataacagcactggaagaagaaaacgcagaattaagacaaagattatctgcaattgaggcggcgcttgcgtctaaataa

SEQ ID NO: 209 - DNA, 2475 bp, Artificial Sequence
  Synthetic: >STF118
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaagcgccattaaacagccctgcactgaccggaacgccaacgacgccaactgcgcgacagggaacgaataatactcagatcgcaaacacggctttcgttatggccgcgattgccgcccttgtagactcgtcgcctgacgcactgaatacgctgaacgagctggcagcggcgctgggcaacgacccgaattttgctaccactatgactaatgcgcttgcgggtaagcaaccgaaagatgctaccctggcggcgctggcggggcttgctactgcggcagacaggtttccgtattttacggggaatgatgttgccagtctggcaactctgacaaaagtcgggcgggatattcttgcgaaatcgaccgtttccgccgttatcgaatatctcggtttacaggaaacggtaaaccgagccgggaacgccgtgcaaaaaaatggcgataccttgtccggtggacttacttttgaaaacgactcaatccttgcctggattcgaaatactgactgggcgaagattggatttaaaaatgatgccgatggtgacactgattcatatatgtggtttgaaacaggtgacaacggcaatgaatacttcaaatggagaagtcgccagagcaccacaacaaaagacctgatgaatcttaaatgggatgctctgtatgttcttgttaaagcccttttcagcagtgaagtaaaaatatctacagtcaatgcactgaggatatttaattcatcttttggtgctatttttcgccgttctgaagaaaacctgtatatcatccctacacgagaaaatgagggtgaaaatggagatattgggccattaaggccattcggcatcaacttaagaacaggagttgtgtctgttggtaatggtgccaggattgatggcgggctggcacttggcacgaataacgcgttgggtgggaactctattgttcttggtgataacgacaccggatttaaacaaaatggcgatggtaatctggatgtttatgctaataacgtccatgttatgcgctttgtttccggaagcattcaaagtaataagaccataaatattacggggcgtgttaatccctcggattacggtaactttgattcccgctatgtgagagatatcagacttggcacacgtgttgtccagaccatgcagaaaggggtgatgtatgagaaagcagggcacgtaattaccgggcttggtattgtcggtgaagtcgatggtgatgaccccgcagtattcaggccaatacaaaaatacatcaatggcacatggtataacgtcgcacaggtgtaa

SEQ ID NO: 210 - DNA, 528 bp, Artificial Sequence
  Synthetic: >STF118 accessory protein
atgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgacgagaataatataattgtcggcatcaccagagatgcttcaacgcttaaccctgaaggtttcagcgttgtcgaggttcctgatattacctccaaccgacgtgctgatgactcaggtaaatggatgtttaaggatggtgccgtgattaagcggatttatacggcagatgaacaggagcaacaggcagaatcacaaaaggcagctttactttccgaagctgaatccgtgattttgccgctggaacgcgctgtcaggctgaatatggcgacggatgaggaacgcagccgactggaagcatgggaacgctacagcgttctggtcagtcgtgtggatcctgcaaatcccgaatggccggaaatgccgcaataa

SEQ ID NO: 211 - DNA, 4044 bp, Artificial Sequence
  Synthetic: K1F
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagacgcaaaaacagcggcggcggggagtgcgtcaacggcatccacgaaggcgacagaggctgcgggaagtgcggtatcagcatcgcagagcaaaagtgcggcagaagcggcggcaatacgtgcaaaaaattcggcaaaacgtgcagaagatatagcttcagctgtcgcgcttgaggatgcggacacaacgagaaaggggatagtgcagctcagcagtgcaaccaacagcacgtctgaaacgcttgctgcaacgccaaaggcggttaaggtggtaatggatgagactaatcgtaaggcacctctggacagtccggcactgaccggaacgccaacagcaccaaccgcgctcaggggaacaaacaatacccagattgcgaacaccgcttttgtactggccgcgattgcagatgttatcgacgcgtcacctgacgcactgaatacgctgaatgaactggccgcagcgctcgggaatgatccagattttgctaccaccatgactaacgcgcttgcgggtaaacaaccgaagaatgcgacactgacggcgctggcagggctttccacggcgaaaaataaattaccgtattttgcggaaaatgatgccgccagcctgactgaactgactcaggttggcagggatattctggcaaaaaattccgttgcagatgttcttgaataccttggggccggtgagaattcgggtgcgaagggcgatggcgttaccgacgacactgcagcgctgacttccgccctgaacgatactccggtgggtcagaaaatcaacggtaacggtaaaacttataaagttacgtccctgccggacatctcccgctttatcaacacccgtttcgtgtatgaacgtatcccaggccagccgctgtactacgcatcggaagagttcgttcagggtgagctttttaaaatcaccgacactccgtattataacgcctggccacaggataaggctttcgtgtacgaaaacgttatctatgctccgtacatgggttccgaccgtcacggtgtcagccgactgcacgtaagctgggtgaaatcgggcgacgatggtcagacctggagcacgcctgagtggctgaccgaccttcatccggactatccgaccgttaactatcactgcatgagcatgggcgtctgtcgcaaccgtctgttcgcaatgatcgaaacccgtacgctggcaaaaaacgctctgactaactgcgccctgtgggatcgtccaatgagccgctctctgcacctgacgggtggtattaccaaagcagcgaaccagcgttacgccaccattcacgtaccggatcatggtctgttcgttggtgactttgtaaatttctctaattctgcagttaccggtgtgtctggcgacatgaccgttgcgaccgtaatcgataaggacaatttcaccgtcctgaccccgaaccagcaaacctctgatcttaacaacgctggcaagaactggcacatgggcactagctttcacaaatctccgtggcgtaaaaccgatctgggcctgatcccgtctgtaactgaagtgcactccttcgcgaccattgataacaacggtttcgctatgggttatcaccaaggtgatgttgcaccgcgtgaagtcggcctcttttattttccggacgcattcaacagcccgtccaactacgtgcgccgtcagattccgtctgaatatgaaccggacgcctccgagccgtgcattaagtactatgacggtgtgctgtacctgattacccgtggcacccgtggtgatcgtctgggttcatctctgcatcgctcccgcgacattggtcagacgtgggaaagtctgcgcttcccgcacaatgttcatcacaccaccctgccgttcgcgaaagtcggcgatgacctgatcatgtttggctccgaacgtgctgaaaacgaatgggaagcgggcgccccagacgatcgctacaaggcatcttacccgcgcaccttctacgcgcgtctgaacgtgaacaactggaacgcagacgatatcgaatgggtaaacatcaccgaccagatctaccagggtggtatcgtgaactctggtgtgggcgttggttccgttgtagttaaagataactacatctattatatgttcggcggcgaagaccacttcaacccgtggacttacggcgataactccgcgaaagacccgttcaaatccgatggtcacccttctgacctctattgttacaaaatgaaaatcggtccggacaaccgtgtttcccgcgattttcgctacggcgctgttccaaaccgtgcagttccggtattcttcgacacgaacggcgtgcgtaccgttccggctccgatggaattcaccggcgacctgggtctgggccacgtaaccattcgtgcctccaccagctctaacatccgttccgaagtactcatggaaggtgaatacggctttatcggtaagtctatcccgacggacaacccggcaggtcagcgtatcatcttctgcggcggtgagggtacctctagcaccaccggcgcgcaaatcaccctgtacggcgctaacaacaccgactctcgtcgtatcgtatacaacggtgatgaacatctgttccagtccgcagacgtgaaaccgtacaacgacaacgtcaccgcactgggtggtccatccaaccgtttcaccactgcgtacctgggttccaacccgatcgttactagcaatggtgaacgcaaaactgaaccggtagtgtttgacgacgcttttctggacgcatggggcgatgttcattacatcatgtatcagtggctggatgccgtgcagctgaaaggtaacgacgcgcgtatccactttggtgtgatcgcacagcagattcgcgatgtcttcatcgcacacggtctgatggatgaaaatagtactaactgtcgctatgcggtgctgtgctatgacaaatacccgcgtatgaccgacaccgtgttctcgcacaatgagattgttgaacataccgatgaagaaggtaacgtgactactaccgaagaaccggtttataccgaagtggttattcacgaagaaggtgaagaatggggcgtgcgtcctgatggtatctttttcgcggaggcagcgtaccagcgtcgcaaactggaacgcatcgaagctcgtctgtcggcactggaacagaaa

SEQ ID NO: 212 - DNA, 2397 bp, Artificial Sequence
  Synthetic: STF66
atggcagtaaagatttcaggagtcctgaaagacggcacaggaaaaccggtacagaactgcaccattcagctgaaagccagacgtaacagcaccacggtggtggtgaacacggtgggctcagagaatccggatgaagccgggcgttacagcatggatgtggagtacggtcagtacagtgtcatcctgcaggttgacggttttccaccatcgcacgccgggaccatcaccgtgtatgaagattcacaaccggggacgctgaatgattttctctgtgccatgacggaggatgatgcccggccggaggtgctgcgtcgtcttgaactgatggtggaagaggtggcgcgtaacgcgtccgtggtggcacagagtacggcagacgcgaagaaatcagccggcgatgccagtgcatcagctgctcaggtcgcggcccttgtgactgatgcaactgactcagcacgcgccgccagcacgtccgccggacaggctgcatcgtcagctcaggaagcgtcctccggcgcagaagcggcatcagcaaaggccactgaagcggaaaaaagtgccgcagccgcagagtcctcaaaaaacgcggcggccaccagtgccggtgcggcgaaaacgtcagaaacgaatgctgcagcgtcacaacaatcagccgccacgtctgcctccaccgcggccacgaaagcgtcagaggccgccacttcagcacgagatgcggtggcctcaaaagaggcagcaaaatcatcagaaacgaacgcatcatcaagtgccggtcgtgcagcttcctcggcaacggcggcagaaaattctgccagggcggcaaaaacgtccgagacgaatgccaggtcatctgaaacagcagcggaacggagcgcctctgccgcggcagcttctgccactgcagcagccaacagtcaaaaagctgcaaaaaccagtgaaaccaactcaaaggcgagcgaaacagcggctgcgaactcagcgaaagcatcggcagcaagccagacggctgcaaaagcaagtgaggatgcagccagagagtatgcaagccaggctgcggagccgtataaacaagttttgcagccgcttcccgatgtgtggataccgtttaacgattcactggatatgattacgggcttttcgccgtcatataaaaagattgttattggtgatgatgaaataacgatgcctggcgataaggttgtaaagtttaaacgcgcatcgaaagcaacctatattaataaatctggtgtgctgacagaggctgccattgacgagccacgatttgaacgtgatggcctgcttattgaggggcaaagaacaaactacatgctcaattcggaaaaccctgccagttgggggcgatcgtcaaatatggatgttcccgaaaccgggacggatagttttggttttacctatggaaagtttgtctgcaacgattctctgattgggcaaacctcagccattaatatggcatcaattgctgcaacaaagtcagttgatgtctcaggcgataataaatacgtgacaacctcatgtcgttttaaaacagaactgcaggtaaggttgcgtatccgatttgataaatatgacggtagcgcaacaacttttcttggtgatgcgtatattgatacacaaacgcttgaaattaatatgacaggtggtgcttccggtagaattacggcacgagtcaggaaggatgaaactacaggatggatttttgctgaggcaacaattcaggcaattgatggtgagttaaaaataggctctcagatacagtattcacctaagcagggaggggcaaccgtatcaggtgactatatttatctggctaccccacaagtagagaatggggcttgtgtatcatcttttattatatcaggaacgacggcggcgactcgtgcgagtgatatggttacgatcccgaccgaaaacaacatttataacagaccgcttacttgtttggtcgaggttaacaggaattggggcgatattcctcctaatgtagcaccgcgtatttttgatttttctggtgtgccgcctattgagtcaatcacatacgcttttaacacaaccgagaaatattacggtcagctttatatgcaaacttataaagcgtcgacaagtagttacgtttctagtttgtttactggtcgaacggatgttcgaaaactcattggtggttttaatatttattctgatggtactaaacgagtagtttctaacggtgaggctactaaaaccatgaaaacggaatggacgggcgtaaaaacgcggacctttattcgaataggaggtcaagccacatcagggacacgtcatctattcggccatttgagaaatcttcgtctctggcataaagaattaactgatgcgcaaatgggggagagtattaaatga

SEQ ID NO: 213 - DNA, 282 bp, Artificial Sequence
  Synthetic: STF66 accessory protein
atgaaagatttaacactcaaatttgccgacagggccgacttttcggcctttatggagagtattggctattatgatgacgagtcgatgcaggatgatattcttattgacgtgataggtaacgtgtacaaagaaaccggagaactgactgaagatggcgaaccggtatgtgttaaggaagacggatattttgtaaacgtgcgcatcattaatgattcgcaaatatcgtcattattcgatgaatacgtggttgctgttgagcatcaacttcgtggctggatgtga

SEQ ID NO: 214 - protein, 1131 aa, Artificial Sequence
  Synthetic: 1A2
MGKGSSKGHTPREAKDNLKSTQLLSVIDAISEGPIEGPVDGLKSVLLNSTPVLDTEGNTNISGVTVVFRAGEQEQTPPEGFESSGSETVLGTEVKYDTPITRTITSANIDRLRFTFGVQALVETTSKGDRNPSEVRLLVQIQRNGGWVTEKDITIKGKTTSQYLASVVMGNLPPRPFNIRMRRMTPDSTTDQLQNKTLWSSYTEIIDVKQCYPNTALVGVQVDSEQFGSQQVSRNYHLRGRILQVPSNYNPQTRQYSGIWDGTFKPAYSNNMAWCLWDMLTHPRYGMGKRLGAADVDKWALYVIGQYCDQSVPDGFGGTEPRITCNAYLTTQRKAWDVLSDFCSAMRCMPVWNGQTLTFVQDRPSDKTWTYNRSNVVMPDDGAPFRYSFSALKDRHNAVEVNWIDPNNGWETATELVEDTQAIARYGRNVTKMDAFGCTSRGQAHRAGLWLIKTELLETQTVDFSVGAEGLRHVPGDVIEICDDDYAGISTGGRVLAVNSQTRTLTLDREITLPSSGTALISLVDGSGNPVSVEVQSVTDGVKVKVSRVPDGVAEYSVWELKLPTLRQRLFRCVSIRENDDGTYAITAVQHVPEKEAIVDNGAHFDGEQSGTVNGVTPPAVQHLTAEVTADSGEYQVLARWDTPKVVKGVSFLLRLTVTADDGSERLVSTARTTETTYRFTQLALGNYRLTVRAVNAWGQQGDPASVSFRIAAPAAPSRIELTPGYFQITATPHLAVYDPTVQFEFWFSEKQIADIRQVETSTRYLGTALYWIAASINIKPGHDYYFYIRSVNTVGKSAFVEAVGRASDDAEGYLDFFKGKITESHLGKELLEKVELTEDNASRLEEFSKEWKDASDKWNAMWAVKIEQTKDGKHYVAGIGLSMEDTEEGKLSQFLVAANRIAFIDPANGNETPMFVAQGNQIFMNDVFLKRLTAPTITSGGNPPAFSLTPDGKLTAKNADISGNVNANSGTLNNVTINENCRVLGKLSANQIEGDLVKTVGKAFPRDSRAPERWPSGTITVRVYDDQPFDRQIVIPAVAFSGAKHEKEHTDIYSSCRLIVRKNGAEIYNRTALDNTLIYSGVIDMPAGHGHMTLEFSVSAWLVNNWYPTASISDLLVVVMKKATAGITIS

SEQ ID NO: 215 - protein, 194 aa, Artificial Sequence
  Synthetic: WT STF accessory protein 1
MAFRMSEQPRTIKIYNLLAGTNEFIGEGDAYIPPHTGLPANSTDIAPPDIPAGFVAVFNSDEASWHLVEDHRGKTVYDVASGDALFISELGPLPENFTWLSPGGEYQKWNGTAWVKDTEAEKLFRIREAEETKKSLMQVASEHIAPLQDAADLEIATKEETSLLEAWKKYRVLLNRVDTSTAPDIEWPAVPVME

SEQ ID NO: 216 - protein, 791 aa, Artificial Sequence
  Synthetic: SIED6
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIADPASVPPLPDIWLPLNDSLEAITGYAPGYKTITIGSDEITVPVNGICQFSRASSATYIDKSGHITVAGNNVPRFEKYGLLIENQRTNMFVNSFNPDAWNKSGGISVTSSTDEFEFKYGRFTVGSDIAGTTTGRNICTVAGNRGIDVTGDDQYSKGPYVTASFRVRSDLNVRARIRFERYNSEGYTFLCDAYLSLQTHELQITGDNAQLLTANFEIDPGSGWIYFQATLKCLPEWGMVGTQLQIAADRAVGSFATGDWIEVTTPQFEYGACATSFIITTTEPATRASDLCKFPLMKNMYTMPFTFMVEVHKNWFIAHNAAPRVIDTENHQSGAPFIMGFGSSGTISQDGYPYCDIGGANRRVYESCGVRDLVMGFRVKADGMTCSFANKHISTETKTVWKYIREAAVIRIGGQTTTGLRHLNGHIKNLRFWNRALSDTQLKEYV

SEQ ID NO: 217 - protein, 89 aa, Artificial Sequence
  Synthetic: SIED6 accessory protein 1
MRDITLRFDNREQFNAIVYDSGLFSLEEENGILVDVIGRVIDYEEPENERCTGIDRGGFFVNMRIVDSSKNISSLMPFITTDQHVRTWA

SEQ ID NO: 218 - protein, 294 aa, Artificial Sequence
  Synthetic: SIED6 accessory protein 2
MVTKTVIPDDIKTLKSDVSKLKNDQGSYATKSYVDSKDETVGDWSASWYQQVLPTSGAIFGRKLRSTHRTAGVEDAYCELYLKKWIDSPGNAMARLNLNDNGENICWDFTNLYGGTMIFPGTSGYLKMGNCLMSYGVRGSNALIKFDNTDSLQIKYANHGSTMTLNTQGTAYSGVSTLLWGNSSRPVVYEIRDDGGLFLFYAQRNPDKTYQLEINGPCKATSFDQVSDRDLKENIRVIDNATERIRLMNGYTYRLKSNGMPYAGVIAQEALNAIPESVGSTIKYKSGDNGSDGE

SEQ ID NO: 219 - protein, 1096 aa, Artificial Sequence
  Synthetic: SIEA11
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAANDNANSRLAKNQNGADIQDKSAFLDNVGVTSLTFMKNNGEMPVDADLNTFGSVKAYSGIWSKATSTNATLEKNFPEDNAVGVLEVFTGGNFAGTQRYTTRDGNLYIRKLIGTWNGNDGPWGAWRHVQAVTRALSTTIDLNSLGGAEHLGLWRNSSSAIASFERHYPEQGGDAQGILEIFEGGLYGRTQRYTTRNGTMYIRGLTAKWDAENPQWEDWNQIGYQTSSTFYEDDLDDLMSPGIYSVTGKATHTPIQGQSGFLEVIRRKDGVYVLQRYTTTGTSAATKDRLYERVFLGGSFNAWGEWRQIYNSNSLPLELGIGGAVAKLTSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

SEQ ID NO: 220 - protein, 175 aa, Artificial Sequence; identical to SEQ ID NO: 32
  Synthetic: SIEA11 accessory protein 1

SEQ ID NO: 221 - protein, 745 aa, Artificial Sequence
  Synthetic: EB6
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKIAMDNANARLAKDRNGADIPNKPLFIQNLGLQETVNKAGNAVQKTGDTLSGGLTFENDSILAWIRNTDWAKIGFKNDADSDTDSYMWFETGDNGNEYFKWRSRQSTTTKDLMNLKWDALYVLVNAIVNGEVISKSANGLRIAYGNYGFFIRNDGSNTYFMLTNSGDNMGTYNGLRPLWINNATGAVSMGRGLNVSGETLSDRFAINSSNGMWIQMRDNNAIFGKNIVNTDSAQALLRQNHADRKFMIGGLGNKQFGIYMINNSRTANGTDGQAYMDNNGNWLCGAQVIPGNYGNFDSRYVRDVRLGTRVVQLMARGGRYEKAGHAITGLRIIGEVDGDDEAIFRPIQKYINGTWYNVAQV

SEQ ID NO: 222 - protein, 175 aa, Artificial Sequence
  Synthetic: EB6 accessory protein 1
MQHLKNIKSGNPKTKEQYQLTKNFDVIWLWSEDGKNWYEEVNNFQDDTIKIVYDENNIIVAITKDASTLNPEGFSVVEIPDITANRRADDSGKWMFKDGAVVKRIYTADEQQQQAESQKAALLSEAENVIQPLERAVRLNMATDEERARLESWERYSVLVSRVDTAKPEWPQKPE

SEQ ID NO: 223 - protein, 1106 aa, Artificial Sequence
  Synthetic: AH11L
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAANDNANSRLAKNQNGADIQDKSVFLDNVGVTSLTFMKNNGEMPLDADLNTFGPVKAYLGIWSKATSTNATLEKNFPEDNAVGVLEVFAAGNFAGTQRFTTRDGNVYMRKLANKWNGTDGPWGVWRHTQSATRPLSTTIDLNTLGAAEHLGLWRNSSSAIASYERNYPEEGGFAQGTLEILEGGNYGRTQRYTTRRGNMYVRCLAASWDASNPQWEPWLRVGHQSESRYYEGDLNDVTSPGIYSVTGKATNGPVLDGNGVTVLGILEVLRRFDGVNVWQRYTTAGTGTTLKGRTFERVFTGSSWSEWREVYTSYSLPLNLGIGGAVAKLTSLDWQTYDFVPGSLITVRLDNMTNIPDGMDWGVIDGNLINIAVGPSDDSGTGRSMHVWRSTVSKANYRFFMVRISGNPGSRTITARRVPIIDEAQTWGAKQTFSAGLSGELSGNAATATKLKTARKINNVSFDGTSDINLTPKNIGAFASGKTGDTVANDKAVGWNWSSGAYNATTGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHIMRFVSGSIQSNKTINITGRVNPSDYGNFDSRYVRDIRLGGAATYKPANNGMTWTHQAPSGCVYSGIIVQDTGSNSADNIGGVYYRPVQKYINGTWYNVAQV

SEQ ID NO: 224 - protein, 175 aa, Artificial Sequence
  Synthetic: AH11L accessory protein 1
MQHLKNITAGNPKTVEQYQLTKGFDVVWFFSEDGKNWYEEQKYFADDTIKIAYDKDNIIRYVEKDVTAIRPDGLSVVEVADITANRRADISGGWMFKDGKVIKRIYTAEELLQQAENRKARLLADAESVILPLERAVRLNMATDEERSRLDAWERYSVLVSRVDPANPEWPEMPQ

SEQ ID NO: 225 - protein, 261 aa, Artificial Sequence; identical to SEQ ID NO: 140
  Synthetic: WW55 3.0 accessory protein 1

SEQ ID NO: 226 - protein, 86 aa, Artificial Sequence; identical to SEQ ID NO: 141
  Synthetic: WW55 3.0 accessory protein 2

SEQ ID NO: 227 - protein, 797 aa, Artificial Sequence
  Synthetic: STF68B
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATASANSQKAAKTSETNAKTSETAAANSAKASAASQTAAKASEDAAREYASQAAEPYKQVLQPLPDVWIPFNDSLEMITGFAPGYKKVTIGDDVITFPSEKVVSFTRSTSATYINKSGSFAFAEINEPRFEKEGLLIEGQRTNTFTNSNNPSLWNYDDKNIEITTSVDEYGFKYGLFDVKETSTTERATIISTGYSRVIDVAANESVTLSCRVKKINGEGIITLRPRISFVNDDGTSNTLVAGSYIDCETGDVLGFSGGDAVNHVIYREANGWLRVEFTYKSPEAKSMYGRFEMGADKRAIKKGDQIMFTTPQFEKGSCASSFIVTSDVAVTRASDVVIMPIRLNWSTPPLSVLMEVNINWDKMPNSEGSARLLNVSITGATTDVADESYMYFGFTSGGARSIITNGKGTKTEYKAYCNRTTRRFIAGFKFTEQKELRAVINGNFGAVDVSQHTRQRYTEGPINIGGQSISGNRHLFGHVRNLRIWHKELTDAQMGERI

SEQ ID NO: 228 - protein, 93 aa, Artificial Sequence
  Synthetic: STF68B accessory protein 1
MRDLTLKFINKADFSAFMDSIGYEDDEVMQNNVLIDVIGNVYKETGELTEDGEPVCVKEDGYFVNVRIINDAKKSSIFDKYAVVVEHQLRGWM

SEQ ID NO: 229 - protein, 346 aa, Artificial Sequence
  Synthetic: STF68B accessory protein 2
MATSTVIPDDIKTLKSDVSKLKNDQGSYATKSYVDSKDETVGDWSASWYQQVLPTSGAIFGRKLRSTHRTAGVEDAYCELYLKKWIDSPGNAMARLNLNDNGTNICWDFTNLYGGTMIFPGDSGYLKMGNCLMSYSKRGSNALIKFDYTDTLQIKYANHGSTMTLNTQGTAHAGVTTRLWGNSSRPVVYEVGVDEALYMFYAQKTTSNTYELTVNGACNASAFNQGSDRDLKDNIQVIDNATDRIRKMNGYTYTLKENGMPYAGVIAQETLEAIPEAVGAMMKYPDGGSGLDGEEGERYYTVDYSGVTGLLVQVARESDDRITALEEENAELRQRLSAIEAALASK

SEQ ID NO: 230 - protein, 879 aa, Artificial Sequence
  Synthetic: STF90B
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSVTNSDSETLAATPKAVKTAYDLANGKYTAQDATTARKGLVQLSSATNSDSETLAATPKAVKSAYDNAEKRLQKDQNGADIPGKDTFTKNIGACRAYSGALSTDAGNWTTAQFIDWLESQGAFNHPYWMCKCSWSYGNNKIITDTDCGTIHLAGCVIEVMGVKAAMTIRVTTPSTSSGGGTTSAQFTYINHGADYAPGWRRDYNTKNKQPAFALGKTGNTVANNKAVGWNWDSGAYCAQDGGASKMVLHFYTGEGSCPAMQFLVDYKNRGIFYRSARDGYGFEADWSEFYTTSRKPTPADILALALSGGSMSGSIKFINDAFLIWERNTDWAKIGFKNDSDADSDSYMWFETGDNGNEYFKWRIRSGSTTKDLMTLKSDALRVTGQVIPSNFSNFDSRYVRDIRLGGAATYKPANNGMTWTHQAPSGCVYTGIIVQDTGSNSADNIGGVYYRPVQKYINGTWYNVAQV

SEQ ID NO: 231 - protein, 175 aa, Artificial Sequence
  Synthetic: STF90B accessory protein
MQHLKNITAGNPKTVEQYQLTKDFDVVWFFSEDGKNWYEEQKYFADDTIKIAYDKDNIIRYVEKDVTAIRPDGLSVVEVADITANRRADISGNWMFKDGTVIKRIYTAEELQQQAENRKARLLADAESVILPLERAVRLNMATEEERSRLERWERYSVLVSRVDPANPEWPEMPQ

SEQ ID NO: 232 - protein, 871 aa, Artificial Sequence
  Synthetic: STF117
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSATNSDSETLAATPKAVKSAYDNAEKRLQKDQNGADIPGKDTFTKNIGACRAYSGALSTEAGNWTTAQFIEWLDSRGAFNHPYWMCKGSWSYANNKIITDTGCGDIHLAGCVVEVMGTKSAITIRVTTPTTSSGGGTTSAQFTYINHGDGYSPGWRRDWNRQGDAMTGTINQDGGSQNAYMSTALCSGTRGGKKYLRKFRGGEGDTIWHETVQGGVVRWATGNTDAQEELSLSSAYGLRSRGEITSSSANGLRIAYGNYGFFIRNDGSSTYFMLTKSGDRLGTYNNLRPLIINDATGAVSMGHGLSVTGDIASSTKVRAGSGKKFTVSSSNTSTKEAAFNLWGNSSRPVVAELGDDAGWHFYSQRNTDNSITFAVNGQVSPSNYSNFDSRYVRDIRLGGAATYKPANNGMTWTHQAPSGCVYSGIIVQDTGSNSADNIGGVYYRPVQKYINGTWYNVAQV

SEQ ID NO: 233 - protein, 175 aa, Artificial Sequence
  Synthetic: STF117 accessory protein 1
MQHLINITAGNPKTVEQYQLTKDFDVVWFFTEDGKNWYEEQKYFADDTIKIAYDKDNIIRYVEKDVTAIRPDGLSVVEVADITANRRADISGNWMFKDGKVIKRIYTAEELQQQAENRKARLLADAESVILPLERAVRLNMATDEERSRLEAWERYSVLVSRVDPANPEWPEMPQ

SEQ ID NO: 234 - protein, 838 aa, Artificial Sequence
  Synthetic: O111
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLDSPALTGTPTAPTALRGTNNTQIANTAFVLAAIADVIDASPDALNTLNELAAALGNDPDFATTMTNALAGKQPKNATLTALAGLSTAKNKLPYFAENDAASLTELTQVGRDILAKNSVADVLEYLGAGENSASGALQKNQNGADIPGKDTFTKNIGACRAYSAWLNIGGDSQVWTTAQFISWLESQGAFNHPYWMCKGSWAYANNKVITDTGCGNICLAGAVVEVIGTRGAMTIRVTTPSTSSGGGITNAQFTYINHGDAYAPGWRRDYNTKNQQPAFALGQTGSRVANDKAVGWNWNSGVYNADISGASTLILHFNMNAGSCPAVQFRVNYRNGGIFYRSARDGYGFEANWSEFYTTTRKPSAGDVGAYTQAECNSRFITGIRLGGLSSVQTWNGPGWSDRSGYVVTGSVNGNRDELIDTTQARPIQYCINGTWYNAGSI

SEQ ID NO: 235 - protein, 177 aa, Artificial Sequence; identical to SEQ ID NO: 34
  Synthetic: O111 accessory protein

SEQ ID NO: 236 - protein, 835 aa, Artificial Sequence
  Synthetic: DC1
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKAAYDLANGKYTAQDATTARKGLVQLSSVTNSDSETLAATPKAVKSAYDNAEKRLQKDQNGADIPGKDTFTKNIGACRAYSGALSTEAGNWTTAQFIDWLESQGAFNHPYWMCKCSWSYGNNKIITDTDCGTIHLAGCVIEVMGVKAAMTIRVTTPSTSSSGGTTSAQFTYINHGADYAPGWRRDYNTKNKQPAFALGKTGNTVANNKAVGWNWDSGAYCAQDGGASKMVLHFYTGEGSCPAMQFLVDYKNRGIFYRSARDGYGFEADWSEFYTTSRKPTPADILALALSGGSMSGSIKFINDAFLIWERNTDWAKIGFKNDSDADSDSYMWFETGDNGNEYFKWRIRSGSTTKDLMTLKSDALRVTGQVIPSNFSNFDSRYVRDIRLGGAATYKPANNGMTWTHQAPSGCVYTGIIVQDTGSNSADNIGGVYYRPVQKYINGTWYNVAQV

SEQ ID NO: 237 - protein, 175 aa, Artificial Sequence
  Synthetic: DC1 accessory protein 1
MQHLINITAGNPKTVEQYQLTKDFDVVWFFSEDGKNWYEEQKYFADDTIKIAYDKDNIIRYVEKDVTAIRPDGLSVVEVPDITANRRADISGGWMFKDGKVIKRIYTAEELQQQAENRKARLLADAESVILPLERAVRLNMATDEERSRLDAWERYSVLVSRVDPANPEWPEMPQ

SEQ ID NO: 238 - protein, 915 aa, Artificial Sequence
  Synthetic: STF94A
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKYTAQDATTARKGLVQLSSAINSDSETLAATPKAVKTAYDLANRKYTAQDATTARKGLVQLSSATNSDSETLAATSKAVKSAYDNAEKRLQKDQNGADIPGKDTFTKNIGACRAYSGALSTEAGNWTTAQFIEWLDSRGAFNHPYWMCKGSWSYANNKIITDTGCGDIHLAGCVVEVMGTKSAITIRVTTPTTSSGGGTTSAQFTYINHGDGYSPGWRRDWNRQGDAMTGTINQDGGSQNAYMSTALCSGTRGGKKYLRKFRGGEGDTIWHETVQGGVVRWATGNTDAQEELSLSSAYGLRSRGEITSLSANGLRIAYGNYGFFIRNDGSSTYFMLTKSGDRLGTYNNLRPLIINDATGAVSMGHGLNVTGDIVSSTKVRAGSGKKFTVSSSNTSTKEAAFNLWGNSSRPVVAELGDDAGWHFYSQRNTDNSITFAVNGQVSPSNYGNFDSRYVRDIRLGGAATYKPANNGMTWTHQAPSGCVYSGIIVQDTGSNSADNIGGIYYRPVQKYINGTWYNVAQV

SEQ ID NO: 239 - protein, 175 aa, Artificial Sequence
  Synthetic: STF94A accessory protein
MQHLINIMAGNPKTVEQYQLTKGFDVVWFFTEDGKNWYEEQKYFADDTIKIAYDKDNIIRYVEKDVTAIRPDGLSVVEVADITANRRADISGGWMFKDGKVIKRIYTAEELQQQAEIRKARLLADAESVILPLERAVRLNMATEEERTRLEAWERYSVLVSRVDPANPEWPEMPQ

SEQ ID NO: 240 - protein, 502 aa, Artificial Sequence
  Synthetic: STF69A
ASATASANSQKAAKTSETNAKASETAAANSAKASAASQTAAKASEDAAREYASQAAEPYKYVLQPLPEVWIPFNDSLDMITGFAPGYKSITVGDDVIALPSEKVVSFTRASTATYIDKSGCFAESAINEPRFEKDGLLIEGQRTNTFSYTNTPVSWNYDTANLTITTGVDEYGFSYGLFGVKETSTTERATLISTGYTRVISVSANESVTLSCRVKKVSGDGIITLRPRISYVNDDGSSNTLTAGAYIDCETGDMLSYSGGEAATYNIFRESNGWIRVEFTYKSPEAKNMYGRFEFGAHQRSIKSGDKLMLTTPQFEKGLNASSFIITTEVGATRASDQVIIPIPFNWATPPVSVLMEVNVNWDSEMPNLEGSARLLNISITGATTEVSDESYMYFGFTTRGKRLIITNGKGTKTEYKAYGNREKRKFVTGFKFTEDKQLQVVVDGILGGSSPSLHTLQRYTAGNINIGGQSSSGNRHLFGHVKNLRIWHKELTEAQMGESI

SEQ ID NO: 241 - protein, 93 aa, Artificial Sequence
  Synthetic: STF69A accessory protein 1
MKDLTLKFEDRADFSAFMESIGYYDDESMQDDILIDVIGNVYKETGELTEDGEPVCVKEDGYFVNVRIINDSQISSLFDEYVVAVEHQLRGWM

SEQ ID NO: 242 - protein, 346 aa, Artificial Sequence
  Synthetic: STF69A accessory protein 2
MATSTVIPDDIKTLKSDVSKLKNDQGSYATKLYVDSKDEIVGDWSASWYQQVLPTSGAIFGRKLRSTHRTAGVEDAYCELYLKKWIDSPGNAMARLNLNDNGTNICWDFTNLYGGTMIFPGDSGYLKMGNCLMSYSKRGSNALIKFDYTDTLQIKYANHGSTMTLNTQGTAYAGVTAQLWGNSSRPVVYEVGVDGGAYMFYAQKNTDNTYMLSVNGACHATAFNQHSDRDLKDNIQVIDNATDRIRKMNGYTYTLKENGMPYAGVIAQEALEAIPEVVGSAMKYQDGASGSEGEEGERYYTVDYSGVTGLLVQVARESDDRITALEEENAELRQRLSAIEAALASK

SEQ ID NO: 243 - protein, 824 aa, Artificial Sequence
  Synthetic: STF118
MAVKISGVLKDGTGKPVQNCTIQLKARRNSTTVVVNTVGSENPDEAGRYSMDVEYGQYSVVMYEKAGHVITGLGIVGEVDGDDPAVFRPIQKYINGTWYNVAQVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAADAKTAAAGSASTASTKATEAAGSAVSASQSKSAAEAAAIRAKNSAKRAEDIASAVALEDADTTRKGIVQLSSATNSTSETLAATPKAVKVVMDETNRKAPLNSPALTGTPTTPTARQGTNNTQIANTAFVMAAIAALVDSSPDALNTLNELAAALGNDPNFATTMTNALAGKQPKDATLAALAGLATAADRFPYFTGNDVASLATLTKVGRDILAKSTVSAVIEYLGLQETVNRAGNAVQKNGDTLSGGLTFENDSILAWIRNTDWAKIGFKNDADGDTDSYMWFETGDNGNEYFKWRSRQSTTTKDLMNLKWDALYVLVKALFSSEVKISTVNALRIFNSSFGAIFRRSEENLYIIPTRENEGENGDIGPLRPFGINLRTGVVSVGNGARIDGGLALGTNNALGGNSIVLGDNDTGFKQNGDGNLDVYANNVHVMRFVSGSIQSNKTINITGRVNPSDYGNFDSRYVRDIRLGTRVVQTMQKG

SEQ ID NO: 244 - protein, 175 aa, Artificial Sequence
  Synthetic: STF118 accessory protein
MQHLKNITAGNPKTVAQYQLTKNFDVIWLWSEEGKNWYEEVSNFQEDTIKIVYDENNIIVGITRDASTLNPEGFSVVEVPDITSNRRADDSGKWMFKDGAVIKRIYTADEQEQQAESQKAALLSEAESVILPLERAVRLNMATDEERSRLEAWERYSVLVSRVDPANPEWPEMPQ

SEQ ID NO: 245 - protein, 1348 aa, Artificial Sequence; identical to SEQ ID NO: 46
  Synthetic: K1

SEQ ID NO: 246 - protein, 798 aa, Artificial Sequence
  Synthetic: STF66
MAVKISGVLKDGTGKPVQNCTIQLKARRNSTTVVVNTVGSENPDEAGRYSMDVEYGQYSVILQVDGFPPSHAGTITVYEDSQPGTLNDFLCAMTEDDARPEVLRRLELMVEEVARNASVVAQSTADAKKSAGDASASAAQVAALVTDATDSARAASTSAGQAASSAQEASSGAEAASAKATEAEKSAAAAESSKNAAATSAGAAKTSETNAAASQQSAATSASTAATKASEAATSARDAVASKEAAKSSETNASSSAGRAASSATAAENSARAAKTSETNARSSETAAERSASAAAASATAAANSQKAAKTSETNSKASETAAANSAKASAASQTAAKASEDAAREYASQAAEPYKQVLQPLPDVWIPFNDSLDMITGFSPSYKKIVIGDDEITMPGDKVVKFKRASKATYINKSGVLTEAAIDEPRFERDGLLIEGQRTNYMLNSENPASWGRSSNMDVPETGTDSFGFTYGKFVCNDSLIGQTSAINMASIAATKSVDVSGDNKYVTTSCRFKTELQVRLRIRFDKYDGSATTFLGDAYIDTQTLEINMTGGASGRITARVRKDETTGWIFAEATIQAIDGELKIGSQIQYSPKQGGATVSGDYIYLATPQVENGACVSSFIISGTTAATRASDMVTIPTENNIYNRPLTCLVEVNRNWGDIPPNVAPRIFDFSGVPPIESITYAFNTTEKYYGQLYMQTYKASTSSYVSSLFTGRTDVRKLIGGFNIYSDGTKRVVSNGEATKTMKTEWTGVKTRTFIRIGGQATSGTRHLFGHLRNLRLWHKELTDAQMGESIK

SEQ ID NO: 247 - protein, 93 aa, Artificial Sequence
  Synthetic: STF66 accessory protein
MKDLTLKFADRADFSAFMESIGYYDDESMQDDILIDVIGNVYKETGELTEDGEPVCVKEDGYFVNVRIINDSQISSLFDEYVVAVEHQLRGWM

SEQ ID NO: 248 - protein, 6 aa, Artificial Sequence
  Synthetic
SAGDAS

SEQ ID NO: 249 - protein, 6 aa, Artificial Sequence
  Synthetic
ADAKKS

SEQ ID NO: 250 - protein, 6 aa, Artificial Sequence
  Synthetic
MDETNR

SEQ ID NO: 251 - protein, 6 aa, Artificial Sequence
  Synthetic
SASAAA

SEQ ID NO: 252 - protein, 6 aa, Artificial Sequence
  Synthetic
GAGENS

SEQ ID NO: 253 - protein, 6 aa, Artificial Sequence
  Synthetic
ATLKQI

SEQ ID NO: 254 - protein, 6 aa, Artificial Sequence
  Synthetic
IIQLED

SEQ ID NO: 255 - protein, 6 aa, Artificial Sequence
  Synthetic
GNIIDL

SEQ ID NO: 256 - protein, 5 aa, Artificial Sequence
  Synthetic
IATRV

SEQ ID NO: 257 - protein, 5 aa, Artificial Sequence
  Synthetic
TPGEL

SEQ ID NO: 258 - protein, 5 aa, Artificial Sequence
  Synthetic
GAIIN

SEQ ID NO: 259 - protein, 5 aa, Artificial Sequence
  Synthetic
NQIID

SEQ ID NO: 260 - protein, 5 aa, Artificial Sequence
  Synthetic
GQIVN

SEQ ID NO: 261 - protein, 5 aa, Artificial Sequence
  Synthetic
VDRAV

SEQ ID NO: 262 - protein, 659 aa, Artificial Sequence
  Synthetic: Phage AG22 stf
MAIYRQGQASMDAQGYVTGYGTKWREQLTLIRPGATIFFLAQPLQAAVITEVISDTSIRAITTGGAVVQKTNYLILLHDSLTVDGLAQDVAETLRYYQGKESEFAGFIEIIKDFDWDKLQKIQEDVKTNADAAAASQQAAKTSENNAKTSATNAANSKKGADTAKAAAESARDAANTAKTGAEAAKSGAESARDAANTAKAGAESARDQAEEYAKQAAEPYKDLLQPLPDVWIPFNDSLDMITGFSPSYKKIVIGDDEITMPGDKIVKFKRASTATYINKSGVLTNAAIDEPRFEKDGLLIEGQRTNLLINSTNPSKWNKSSNMILDRSGVDDFGFQYAKFTLKPEMVGQTSSINIVTVSGSRGFDVTGNEKYVTISCRAQSGTPNLRCRLRFENYDGSAYASLGDAYVNLTDLSIEKTGGAANRITARAVKDEASKWIFFEATIKALDTENMIGAMVQYAPAKDGGGTGADDYIYIATPQVEGGVCASSFIITEATPVTRASDMVTIPIKNNLYNLPFTVLCEVHKNWYITPNAAPRVFDTGGHQSGAAIILAFGSADGDNDGFPYCDIGKSNRRVNENAKLKKMIIGMRVKSDYNTCCVSNARISSETKTEWRYIVSTATIRIGGQTSTGERHLFGHVRNFRIWHKALTDHQLGEIV

SEQ ID NO: 263 - protein, 909 aa, Artificial Sequence
  Synthetic: Phage SIEA11 stf
MSTKFKTVITTAGAAKLAAATVPGGKKVTLSAMAVGDGNGKLPVPDAGQTKLVHEVWRHALNKVSVDNKNKNYIVAELVVPPEVGGFWMRELGLYDDAGTLIAVSNMAESYKPELAEGSGRAQTCRMVIIVSNVASVELSIDASTVMATQDYVDDKIAEHEQSRRHPDATLTEKGFTQLSSATNSTSESLAATPKAVKAANDNANSRLAKNQNGADIQDKSAFLDNVGVTSLTFMKNNGEMPVDADLNTFGSVKAYSGIWSKATSTNATLEKNFPEDNAVGVLEVFTGGNFAGTQRYTTRDGNLYIRKLIGTWNGNDGPWGAWRHVQAVTRALSTTIDLNSLGGAEHLGLWRNSSSAIASFERHYPEQGGDAQGILEIFEGGLYGRTQRYTTRNGTMYIRGLTAKWDAENPQWEDWNQIGYQTSSTFYEDDLDDLMSPGIYSVTGKATHTPIQGQSGFLEVIRRKDGVYVLQRYTTTGTSAATKDRLYERVFLGGSFNAWGEWRQIYNSNSLPLELGIGGAVAKLTSLDWQTYDFVPGSLITVRLDNMTNIPDGMDWGVIDGNLINISVGPSDDSGSGRSMHVWRSTVSKANYRFFMVRISGNPGSRTITTRRVPIIDEAQTWGAKQTFSAGLSGELSGNAATATKLKTARKINNVSFDGTSDINLTPKNIGAFASGKTGDTVANDKAVGWNWSSGAYNATIGGASTLILHFNIGEGSCPAAQFRVNYKNGGIFYRSARDGYGFEADWSEFYTTTRKPTAGDVGALPLSGGQLNGALGIGTSSALGGNSIVLGDNDTGFKQNGDGNLDVYANSVHVMRFVSGSVQSNKTINITGRVNPSDYGNFDSRYVRDVRLGTRVVQTMQKGVMYEKAGHVITGLGIVGEVDGDDPAVFRPIQKYINGTWYNVAQV

What is claimed is:

1. A chimeric receptor binding protein (RBP) wherein the chimeric RBP comprises a fusion between the N-terminal domain of a RBP from a lambda-like or lambda bacteriophage, wherein said lambda-like bacteriophage comprises amino acid sequence homology of around 35% identity for 45 amino acids or more, around 50% identity for 30 amino acids or more, or around 90% identity for 18 amino acids or more in one or more of three amino acid regions ranging from positions 1-150, 320-460, and 495-560 with reference to the lambda bacteriophage stf sequence of SEQ ID NO: 1, and the C-terminal domain of a different RBP and wherein said N-terminal domain is fused to said C-terminal domain within one of the amino acid regions selected from positions 1-150, 320-460 or 495-560 of the N-terminal RBP with reference to the lambda stf sequence (SEQ ID NO:1), wherein said region of fusion within the N-terminal RBP from positions 1-150, 320-460 or 495-560 comprises amino acid sequence homology of around 35% identity for 45 amino acids or more, around 50% identity for 30 amino acids or more, or around 90% identity for 18 amino acids or more with reference to the lambda bacteriophage stf sequence of SEQ ID NO:1.

2. The chimeric RBP of claim 1, wherein said different RBP is derived from any bacteriophage or bacteriocin.

3. The chimeric receptor binding protein (RBP) of claim 2, wherein the different RBP comprises amino acids sequence homology of around 35% identity for 45 amino acids or more, around 50% identify for 30 amino acids or more, or around 90% identity for 18 amino acids or more in one or more of three amino acids regions ranging from positions 1-150, 320-460, and 495-560 with reference to the lambda bacteriophage stf sequence of SEQ ID NO: 1.

4. The chimeric RBP of claim 1, wherein said N-terminal domain of the chimeric RBP is fused to said C-terminal domain within one of the amino acid regions selected from positions 80-150, 320-460, or 495-560 of the N-terminal RBP.

5. The chimeric RBP of claim 1, wherein the N-terminal domain and the C-terminal domain are fused within said region at an insertion site having at least 80% identity with insertion site selected from the group consisting of amino acids SAGDAS (SEQ ID NO:248), ADAKKS (SEQ ID NO: 249), MDETNR (SEQ ID NO: 250), SASAAA (SEQ ID NO: 251), and GAGENS (SEQ ID NO: 252).

6. The chimeric RBP of claim 1, wherein the chimeric RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 123-129, 130, 131, 132, 135, 138, 139, 142, 145, 148, 151, 216, 219, 221, 223, 227, 230, 232, 234, 236, 238, 240, 243, 245 or 246.

7. The chimeric RBP of claim 1, wherein the C-terminal domain of the different RBP has a depolymerase activity against an encapsulated bacterial strain.

8. A bacterial delivery vehicle comprising the chimeric RBP of claim 1.

9. The bacterial delivery vehicle of claim 8 wherein said different RBP is derived from any bacteriophage or bacteriocin.

10. The bacterial delivery vector of claim 9, wherein the different RBP comprises amino acids sequence homology of around 35% identity for 45 amino acids or more, around 50% identify for 30 amino acids or more, or around 90% identity for 18 amino acids or more in one or more of three amino acids regions ranging from positions 1-150, 320-460, and 495-560 with reference to the lambda bacteriophage stf sequence of SEQ ID NO: 1.

11. The bacterial delivery vehicle of claim 8, wherein said N-terminal domain of the chimeric RBP is fused to said C-terminal domain within one of the amino acid regions selected from positions 80-150, 320-460 or 495-560 of the N-terminal RBP with reference to the lambda stf sequence.

12. The bacterial delivery vehicle of claim 8, wherein the N-terminal domain and the C-terminal domain of the chimeric RBP are fused within said region at an insertion site having at least 80% identity with insertion site selected from the group consisting of amino acids SAGDAS (SEQ ID NO: 248), ADAKKS (SEQ ID NO: 249), MDETNR (SEQ ID NO: 250), SASAAA (SEQ ID NO: 251), and GAGENS (SEQ ID NO: 252).

13. The bacterial delivery vehicle of claim 8, wherein the chimeric RBP comprises the amino acid sequence of SEQ ID NO: 2, 4, 7, 9, 12, 15, 17, 20, 23, 24, 25, 27, 29, 31, 33, 35, 37, 39, 41, 42, 44, 46, 47, 48, 49, 50, 51, 52, 53, 56, 59, 123-129, 130, 131, 132, 135, 138, 139, 142, 145, 148, 151, 216, 219, 221, 223, 227, 230, 232, 234, 236, 238, 240, 243, 245 or 246.

14. The bacterial delivery vehicle of claim 8, wherein the C-terminal domain of the different RBP has a depolymerase activity against an encapsulated bacterial strain.

15. The bacterial delivery vehicle of claim 8, further comprising a nucleic acid payload encoding a protein of interest or a nucleic acid of interest.

16. The bacterial delivery vehicle of claim 15, wherein the nucleic acid of interest is selected from the group consisting of a Cas nuclease gene, a Cas9 nuclease gene, a guide RNA, a CRISPR locus, a toxin gene, a gene expressing an enzyme such as a nuclease, a kinase, a TALEN, a ZFN, a meganuclease, or a recombinase, a bacterial receptor gene, a membrane protein gene, a structural protein gene, a secreted protein gene, a gene expressing resistance to an antibiotic or resistance to a drug in general, a gene expressing a toxic protein or a toxic factor, and a gene expressing a virulence protein or a virulence factor, or any combination thereof.

17. The bacterial delivery vehicle of claim 15, wherein the protein of interest is a nuclease that targets cleavage of a host bacterial cell genome or a host bacterial cell plasmid.

18. The bacterial delivery vehicle of claim 17, wherein the cleavage occurs in an antibiotic resistant gene.

19. The bacterial delivery vehicle of claim 15, wherein the nucleic acid payload encodes a therapeutic protein.

20. The bacterial delivery vehicle of claim 15, wherein the nucleic acid payload encodes an anti-sense nucleic acid molecule.

21. A pharmaceutical or veterinary composition comprising one or more bacterial delivery vehicles of claim 8 and a pharmaceutically-acceptable carrier.

* * * * *